(12) United States Patent
Pentecost et al.

(10) Patent No.: US 11,578,116 B2
(45) Date of Patent: Feb. 14, 2023

(54) EXTRACELLULAR VESICLES COMPRISING ENGINEERED FUSION PROTEINS

(71) Applicant: DIADEM BIOTHERAPEUTICS INC., Torrance, CA (US)

(72) Inventors: Mickey Pentecost, West Hollywood, CA (US); Wojciech Bartkowski, La Crescenta, CA (US)

(73) Assignee: DIADEM BIOTHERAPEUTICS INC., Torrance, CA (US)

( * ) Notice: Subject to any disclaimer, the term of this patent is extended or adjusted under 35 U.S.C. 154(b) by 0 days.

(21) Appl. No.: 17/377,550

(22) Filed: Jul. 16, 2021

(65) Prior Publication Data

US 2021/0379198 A1 Dec. 9, 2021

Related U.S. Application Data

(63) Continuation of application No. PCT/US2021/016949, filed on Feb. 5, 2021.

(60) Provisional application No. 62/970,374, filed on Feb. 5, 2020.

(51) Int. Cl.

| | |
|---|---|
| *C07K 14/705* | (2006.01) |
| *A61K 47/69* | (2017.01) |
| *A61K 47/58* | (2017.01) |
| *A61K 47/62* | (2017.01) |
| *A61K 47/54* | (2017.01) |
| *A61P 27/02* | (2006.01) |
| *A61P 37/06* | (2006.01) |
| *C12N 9/14* | (2006.01) |
| *C07K 14/75* | (2006.01) |
| *A61K 38/00* | (2006.01) |

(52) U.S. Cl.
CPC ...... *C07K 14/70532* (2013.01); *A61K 47/544* (2017.08); *A61K 47/605* (2017.08); *A61K 47/62* (2017.08); *A61K 47/69* (2017.08); *A61K 47/6901* (2017.08); *A61K 47/6911* (2017.08); *A61K 47/6917* (2017.08); *A61P 27/02* (2018.01); *A61P 37/06* (2018.01); *C07K 14/705* (2013.01); *C07K 14/7056* (2013.01); *C07K 14/70521* (2013.01); *C07K 14/70596* (2013.01); *C07K 14/75* (2013.01); *C12N 9/14* (2013.01); *A61K 38/00* (2013.01); *C07K 2319/01* (2013.01); *C07K 2319/02* (2013.01); *C07K 2319/035* (2013.01); *C07K 2319/055* (2013.01); *C07K 2319/30* (2013.01); *C07K 2319/74* (2013.01); *C07K 2319/75* (2013.01); *C07K 2319/912* (2013.01); *C07K 2319/915* (2013.01); *C12Y 304/24081* (2013.01)

(58) Field of Classification Search
CPC ........ C07K 14/70532; C07K 14/70521; C07K 14/70596; A61K 47/6917
See application file for complete search history.

(56) References Cited

U.S. PATENT DOCUMENTS

| | | | |
|---|---|---|---|
| 7,704,964 B2 | 4/2010 | Delcayre et al. | |
| 9,546,371 B2 | 1/2017 | Mamoun et al. | |
| 9,611,481 B2 | 4/2017 | Mamoun | |
| 10,195,290 B1 | 2/2019 | Dooley et al. | |
| 10,370,663 B2 | 8/2019 | Lotvall et al. | |
| 10,617,768 B2 | 4/2020 | Lu et al. | |
| 10,695,443 B2 | 6/2020 | Lotvall et al. | |
| 10,723,782 B2 | 7/2020 | Lewis et al. | |
| 11,260,076 B2 * | 3/2022 | Copik | A61P 37/02 |
| 2016/0137716 A1 | 5/2016 | El Andaloussi et al. | |
| 2017/0087087 A1 | 3/2017 | Leonard et al. | |
| 2017/0258938 A1 | 9/2017 | Lotvall et al. | |
| 2017/0333479 A1 | 11/2017 | Copik et al. | |
| 2018/0015182 A1 | 1/2018 | Lu et al. | |
| 2018/0117117 A1 | 5/2018 | Choi et al. | |
| 2018/0135056 A1 | 5/2018 | Lotvall et al. | |

(Continued)

FOREIGN PATENT DOCUMENTS

| | | |
|---|---|---|
| WO | 2018015535 A1 | 1/2018 |
| WO | 2018129207 A1 | 7/2018 |

(Continued)

OTHER PUBLICATIONS

Kalluri R and LeBleu VS (Feb. 7, 2020) Science. 367(640). 16 pages (DOI: 10.1126/science.aau6977).*
Barile L and Vassalli G (2017) Pharmacology and Therapeutics. 174:63-78. (http://dx.doi.org/10/1016/j.pharmthera.2017.02.020).*
Ferguson SW and Nguyen J (2016) Journal of Controlled Release. 228:179-190. (http://dx.doi.org/10/1016/j.conrel.2016.02.037).*

(Continued)

*Primary Examiner* — Robert S Landsman
(74) *Attorney, Agent, or Firm* — Nixon Peabody LLP

(57) ABSTRACT

Described herein are compositions and techniques related to generation and therapeutic application of artificial synapses. Artificial synapses are engineered extracellular vesicles, including exosomes, which incorporate sticky binders on their surface to anchor signaling domains against biological targets, such as receptors. These engineered additives can be organized in genetic vector constructs, expressed in mammalian cells, wherein the sticky binders attach to extracellular vesicles such as exosomes, thereby presenting their joined signaling domains which are rapidly taken up by recipient cells. Artificial synapses adopt the hallmark biophysical and biochemical features of extracellular vesicles, allowing for rapid deployment and scale-up. Importantly, this strategy can allow for kinetically favorable signal generation and signal propagation. This includes, for example, increasing density of agonist presentation to support receptor clustering—an onerous barrier for traditional receptor targeting strategies.

20 Claims, 102 Drawing Sheets
Specification includes a Sequence Listing.

(56) References Cited

U.S. PATENT DOCUMENTS

| | | |
|---|---|---|
| 2018/0236104 A1 | 8/2018 | Lotvall et al. |
| 2019/0015333 A1 | 1/2019 | Lu et al. |
| 2019/0060483 A1 | 2/2019 | Dooley et al. |
| 2019/0117792 A1 | 4/2019 | Dooley et al. |
| 2019/0151456 A1 | 5/2019 | McConnell et al. |
| 2019/0167810 A1 | 6/2019 | Hean et al. |
| 2019/0202892 A1 | 7/2019 | Lewis et al. |
| 2019/0224331 A1 | 7/2019 | Wiklander |
| 2019/0290585 A1 | 9/2019 | Wiklander |
| 2019/0388347 A1 | 12/2019 | Wiklander et al. |
| 2020/0054686 A1 | 2/2020 | Rodriguez-Borlado et al. |
| 2020/0062813 A1 | 2/2020 | Nordin et al. |
| 2020/0109183 A1 | 4/2020 | Wiklander et al. |
| 2020/0155703 A1 | 5/2020 | Lotvall et al. |
| 2020/0163998 A1 | 5/2020 | Park et al. |
| 2020/0206360 A1 | 7/2020 | Choi et al. |
| 2020/0207833 A1 | 7/2020 | El Andaloussi et al. |
| 2020/0222556 A1 | 7/2020 | Dooley et al. |
| 2020/0347112 A1 | 11/2020 | McConnell et al. |
| 2020/0407419 A1 | 12/2020 | Lewis et al. |
| 2021/0371497 A1 | 12/2021 | Pentecost et al. |

FOREIGN PATENT DOCUMENTS

| | | |
|---|---|---|
| WO | 2020154746 A1 | 7/2020 |
| WO | 2020257710 A1 | 12/2020 |
| WO | 20211590169 A1 | 8/2021 |

OTHER PUBLICATIONS

Murphy DE, et al. (2019) Experimental & Molecular Medicine. 51:32. (https://doi.org/10/1038/s12276-019-0223-5).*

Liu C and Su C (2019) Theranostics. 9(4):1015-1028. (doi: 10.7150/thno.30853).*

Andreu et al., Tetraspanins in Extracellular Vesicle Formation and Function, Frontiers in Immunology, 2014, vol. 5 (442), pp. 1-12.

Armstrong et al., Re-Engineering Extracellular Vesicles as Smart Nanoscale Therapuetics, ACS Nano, 2017, vol. 11(1), pp. 69-83.

"Engineered", Lexico, available online at https://www.lexico.com/en/definition/engineered, 4 pages (accessed on Mar. 7, 2022) (Year: 2022).

"Homology", Encyclopedia Britannica, available online at www.britannica.com/science/homology-evolution, 3 pages at p. 1, 1st paragraph (accessed on Mar. 8, 2022) (Year: 2022).

Kanduc et al., Homology, Similarity and Identity in Peptide Epitope Immunodefinition, Journal of Peptide Science, 2012, vol. 18, pp. 487-494.

Pearson et al., An Introduction to Sequence Similarity ("Homology") Searching, Curr Protoc Bioinformatics, 2013, 9 pages.

Samudrala et al., Difference between Homology, Identity and Similarity, available on line at http://www.bio.net/mm/proteins/1998-July/006538.html, 1 page (1998) (Year: 1998).

Yang et al., Engineering of Fc Fragments with Optimized Physicochemical Properties Implying Improvement of Clinical Potentials for Fc-Based Therapuetics, Frontiers in Immunology, 2018, vol. 8, 14 pages.

ISR and WO for PCT/US2021/016949 dated Jul. 22, 2021, 12 pages.

U.S. Appl. No. 62/864,566, filed Jun. 21, 2019, 6 pages.

U.S. Appl. No. 62/875,001, filed Jul. 17, 2019, 9 pages.

Riazifar et al., Stem Cell Extracellular Vesicles: Extended Messages of Regeneration; Annu Rev Pharmacol Toxicol., 2017, 57:125-154.

Riazifar et al., Stem Cell-Derived Exosomes as Nanotherapeutics for Autoimmune and Neurodegenerative Disorders, ACS Nano. 2019, 13(6):6670-6688.

Yáñez-Mó, et al., Biological properties of extracellular vesicles and their physiological functions, J Extracell Vesicles, 2015(4):27066. Published May 14, 2015. doi:10.3402/jev.v4.27066.

Yadid et al., Endothelial extracellular vesicles contain protective proteins and rescue ischemia-reperfusion injury in a human heart-on-chip, 2020, Science Translation Medicine 12, 17 pages.

de Abreu et al., Native and bioengineered extracellular vesicles for cardiovascular therapeutics, Nature Reviews Cardiology, 2020, 17(11), 685-697.

Zhang et al., Characterization of Protein Profiling and mRNA Expression of LLC Exosomes, 2019, Protein J 38:586-597 (2019).

Zha et al., Extracellular vesicles: An overview of biogenesis, function, and role in breast cancer, Tumor Biology, 2017, pp. 1-7.

Tan et al., Thrombin stimulated platelet-derived exosomes inhibit platelet-derived growth factor receptor-beta expression in vascular smooth muscle cells, Cellular Physiology and Biochemistry, 2016, 38:2348-2365.

Kalluri et al., The biology, function, and biomedical applications of exosomes, Science 2020, 367, 17 pages.

Resh, Fatty acylation of proteins: new insights into membrane targeting of myristoylated and palmitoylated proteins, Biochimica et Biophysica Acta (BBA)—Molecular Cell Research, 1999, vol. 1451, Issue 1, pp. 1-17, doi.org/10.1016/S0167-4889(99)00075-0.

Alberts et al., Membrane Proteins, Molecular Biology of the Cell, 2020, 4th edition, New York: Garland Science, 2002, 16 pages, https://www.ncbi.nlm.nih.gov/books/NBK26878/.

Apolloni et al., H-ras but Not K-ras Traffics to the Plasma Membrane through the Exocytic Pathway, Molecular and Cellular Biology, Apr. 2000, 20 (7) 2475-2487, DOI: 10.1128/MCB.20.7.2475-2487.2000.

Dawaliby et al., Phosphatidylethanolamine Is a Key Regulator of Membrane Fluidity in Eukaryotic Cells, Membrane Biology, 2016, vol. 291(7), 10 pages, doi.org/10.1074/jbc.M115.706523.

Deschenes, Protein Palmitoylation, Encyclopedia of Biological Chemistry (Second Edition), Academic Press, 2013, pp. 645-647, ISBN 9780123786319, https://doi.org/10.1016/B978-0-12-378630-2.00022-0.

Palsuledesai et al., Protein Prenylation: Enzymes, Therapeutics, and Biotechnology Applications, ACS Chemical Biology 2015 10 (1), 51-62, DOI: 10.1021/cb500791f.

Hung et al., Stabilization of exosome-targeting peptides via engineered glycosylation, J Biol Chem, Mar. 27, 2015;290(13):8166-72, doi: 10.1074/jbc.M114.621383.

O'Shea et al., Peptide 'Velcro': design of a heterodimeric coiled coil, Curr Biol. Oct. 1, 1993;3(10):658-67. doi:10.1016/0960-9822(93)90063-t. PMID: 15335856.

Udenwobele, et al., Myristoylation: An Important Protein Modification in the Immune Response, Frontiers in Immunology, vol. 8, 2017, DOI=10.3389/fimmu.2017.00751.

Kinoshita, Biosynthesis and biology of mammalian GPI-anchored proteins Open Biol. 2020, 16 pages, 10190290, http://doi.org/10.1098/rsob.190290.

Chen et al., Fusion protein linkers: property, design and functionality, Adv Drug Deliv Rev. 2013, 65(10): 1357-1369 doi:10.1016/j.addr.2012.09.039.

Müller et al., Protein fusions to coiled-coil domains, Methods Enzymol. 2000; 328:261-82. doi: 10.1016/s0076-6879(00)28402-4. PMID: 11075350.

Whitford et al., Exosome manufacturing status, Future Med Chem. May 2019; 11(10): 1225-1236. doi: 10.4155/fmc-2018-0417. PMID: 31280675.

Patel et al., Towards rationally designed biomanufacturing of therapeutic extracellular vesicles: impact of the bioproduction microenvironment, Biotechnol Adv. Dec. 2018; 36(8):2051-2059. doi: 10.1016/j.biotechadv.2018.09.001. Epub Sep. 12, 2018. PMID: 30218694; PMCID: PMC6250573.

Ng et al., Bioprocess decision support tool for scalable manufacture of extracellular vesicles, Biotechnol Bioeng. Feb. 2019; 116(2):307-319. doi: 10.1002/bit.26809. Epub Nov. 8, 2018. PMID: 30063243; PMCID: PMC6322973.

Paganini et al., Scalable Production and Isolation of Extracellular Vesicles: Available Sources and Lessons from Current Industrial Bioprocesses, Biotechnol J. Oct. 2019;14 (10):e1800528. doi: 10.1002/biot.201800528. Epub Jul. 8, 2019. PMID: 31140717.

Zhang et al., Exosome: A Review of Its Classification, Isolation Techniques, Storage, Diagnostic and Targeted Therapy Applications, Int J Nanomedicine, Sep. 22, 2020;15:6917-6934. doi: 10.2147/IJN.S264498. PMID: 33061359; PMCID: PMC7519827.

(56) References Cited

OTHER PUBLICATIONS

Kluszczyńska et al., Methods for the Determination of the Purity of Exosomes, Curr Pharm Des. 2019; 25(42):4464-4485. doi: 10.2174/1381612825666191206162712. PMID: 31808383.
Nolan et al. Analysis of Individual Extracellular Vesicles by Flow Cytometry, Methods Mol Biol. 2018; 1678:79-92. doi: 10.1007/978-1-4939-7346-0_5. PMID: 29071676.
Doyle et al., Overview of Extracellular Vesicles, Their Origin, Composition, Purpose, and Methods for Exosome solation and Analysis, Cells, Jul. 15, 2019; 8(7):727. doi: 10.3390/cells8070727. PMID: 31311206; PMCID: PMC6678302.
Pugholm et al., Antibody-Based Assays for Phenotyping of Extracellular Vesicles, Biomed Res Int. 2015; 2015:524817. doi: 10.1155/2015/524817. Epub Dec. 3, 2015. PMID: 26770974; PMCID: PMC4681819.
Shao et al., New Technologies for Analysis of Extracellular Vesicles, Chem Rev. Feb. 28, 2018; 118(4):1917-1950. doi: 10.1021/acs.chemrev.7b00534. Epub Jan. 31, 2018. PMID: 29384376; PMCID: PMC6029891.
Elshaer et al., Adipose stem cells and their paracrine factors are therapeutic for early retinal complications of diabetes in the Ins2Akita mouse, Stem Cell Research & Therapy, 2018, 9:322, 18 pages.
Jha et al., TSG-6 in conditioned media from adipose mesenchymal stem cells protects against visual deficits in mild traumatic brain injury model through neurovascular modulation, Stem Cell Research & Therapy, 2019, 10:318, 15 pages.
Jha et al., Concentrated conditioned media from adipose tissue erived mesenchymal stem cells mitigates visual deficits and retinal inflammation following mild traumatic brain injury, International Journal of Molecular Sciences, 2018, 19:1-22.

\* cited by examiner

Phosphatidylserine binding: Lactadherin (MFGE8) C1C2

>NM_005928.4 Homo sapiens milk fat globule-EGF factor 8 protein (MFGE8), transcript variant 1, mRNA
AGAACCCCGGCGGGGTCTGAGCAGCCCAGGCCCCGCGTCCCCGCAGCATGCCCCGGCCGCGCCTGCTGGCCGCGCTGTGCGGCGCGCTGCTG
CGCCCCAGCCTCCTCGCCCTGGATATCTGTTCCAAAAACCCTGCCACAGGTGGTTTATGCGAGGAGATTTCCCAAGAAGTGCGAGGAGATGTCTTCCCCTC
GTACACCTGCACGTGCCTTAAGGCTACGCGGGCAACCACTGTGAGACGAAATGTGTGAGCACTGGGCTGTGGAACATTGCCAACTCACAGATGCC
GCCTCGTCGTGTGCGTGACATCAGGTGACCTTCTGGGTTTGCAGCATTGGGTCGCGGAGGATGTGGGTAACGCGCAGAGGTGTGATGCGCCTTGGCCAGTCATGAGTACCTGAAGGCC
ACGATAACCCCTGGCCTACAGCTGTGCGGAGGATGTCGATTCATCATGATTGACACGAATTGCCAGTTTGTGGTAACTGAACAAAAACGCGGTGCAT
TTCAAGGTGGCCTACAGCCTGTTTGAGAGGCTCAGTACGTGAGATTGTACCCCACGAGCTGCCACACGAGCTACAGCAGCGCCTCCAGCAGTACAAGAGACCTGGGCGTTGCATCTCTTCAGTGGAA
GTCAACCTGTTTGAGACCCCTGTGGGCTTGGACACAGGGGCCCGTCGAATCCCTGAAGAATAACAGCATCCCTGGGGTGCCGGAGTACGTACAAGGTTCTGGCATCATTACAAGGTTGCTCTACAGTAATGACAGTGCGAACTGGCTGATGTGCGCA
ACGGATGCGCCAATCCCTGGGCTGACAAGCAGGGCAACTTCAACGCCTGGGTTGCGGAGCTACAGATCAGTGGCTCCAGCTACAAGACCTGGGGTTGCATCTTTCAGTGGAA
CCCCTCTATGCAGGCATCATCACCCAGGGCAGTAGATCTTCCCTGCAACTGGAGCTGCTGGGCTGTTAGTGGCCATCCCTCTGCTTTCTCCCACAGTGCCTGCC
GGTGACAGGCATCATCACCCAGGGCAGTAGATCTTCCCTGCAACTGGAGCTGCTGGGCTGTTAGTGGCCATCCCTCTGCTTTCTCATGGGCCCGCTGCC
CAGGAGGAGCGGCAGCAGTGGCTAAGATCTTCCCTGCAACTGGAGCTGCTGGGCTGTTAGTGGAGGGTGTTGAGACGCCATCCTGTTCCTGCTTTCCATGGGCCCGCTGCC
TCCTGCCTGTAGCCTGGCACAACCGCATCGCCCTGCGCCGCATCGCCATCCTGGGCGCTGGGGAAGGGAGGGTGTTCAGAGGCCAGGCAGCAGACAGTTCAGCCCGTTCTATCATCACCATAGGGCTCCCTTCCCA
TCTTGGCTTCTCAGCCCTTTAAATCACCATAGGGCTCCCTTCCCAGCCCCCTGCGCTGCAGCCCTAAGCCCCCGGTTCCTGCCGGATCGAGTAGGTCTGGAT
CCCCTCCACTCTCACGGGCAAAGTAGGGCGTGTGTTTCCTGCCGATCCGAGTTCCGGACGATAACAGCCTCTTGCCCTGTCTGTGTCTCTAGCCCTCTCACACATCACA
GGACAGGAAAGGCAAGAAAGGCCTCAAGAAAGGCCCAGGAGCACTTCCCTGTCCCAGACACTTCCCTGTCTCCCCTTGTCCCTGGTTCCTGTCCCCTGGGTACCCATGTGGCCACAACTGCT
TTCCCATGGTGGCCTCAAGAAAGGCCCAGGAGCACTTCCCTGTCCCAGACACTTCCCTGTCTCCCCTTGTCCCTGGTTCCTGTCCCCTGGGTACCCATGTGGCCACAACTGCT
GTGGCCCCCGTGTCCCAAGACACTTCCCCAAGACACTTCCCTGTCTCCCCTTGTGTCTCCCTTGTCCCTGGTTCCTGTCCCCTGGGTGGGGGGGTCTATGGGGA
GAAAGGGAGCGAGGTCAGAGGAGGAGGCATGAGTAGCAGATCTTCCCTGCAACTGGAGCTGCTGGGCTGTTAGTGGGGGGTGGGGCAGTCCCCAGAGAGGACACAGGCAGCTTCCAAAATATA
TTTATCTTCTTCACGGGAA >NP_005919.2 lactadherin isoform a preproprotein [Homo sapiens]
MPRPRLLAALCGALLCAPSLLVALDICSKNPCHNGGLCEEISQEVRGDVFPSYTCTCLKGYAGNHCETKCVEPLGLENGNIANSQIAASSVRVTFLGLQHWVPELARLNRAG
MVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACT
LRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSN
DSANWTEYQDPRTGSSKIFPGNWDNHSHKKNLFETPILARYVRILPVAWHNRIALRELLGC

*FIG. 2A*

Lipid binding: CD55 (DAF) Glycosylphosphatidylinositol (GPI) Anchor

>NM_000574.5 Homo sapiens CD55 molecule (Cromer blood group) (CD55), transcript variant 1, mRNA
CTGCTTACTGCAACTCGCTCCGGCCGCTGGGCGCTAGCTGCGACTCGGACGAGTCCCGGCCGAGTCCTGTTCTAACCGGCCGTCCTTGCGCGGGCCGAGCG
TGCCCGCGGCCGCTGCCCCCTCCTCCGGAGCCGTACAAGTTTCCCGGAGCAGTTTCCCGGAGCCTGTGCTGCCGCCGTGTGGGGTGACTGTGCCTCCCAGATGTACCTAATG
CCAGCCAGCTTTGGAAGGCCGTACAAGTATATTGAAGAGTTCTGCAACAAGGCTAAATTCTGCATCCCTCAAACAGCCTTATATCACTCAGAATTATTT
TTAAGGGCAGTCAATGTCAGATATTGAAGAGTTCTGCAACAAGGCTAAATTCTGCATCCCTCAAACAGCCTTATATCACTCAGAATTATTT
TCCAGTCGGTACTGTTGTGAATATGCCGTCCAGTTGCCGTCCAGTTACAGGAAGAGAACCTTCTGCAAACAACTTGCCTTCAGAATTAAAATGGTCACAGCAGTCGAA
TTTGTAAAAGAAATCATGCCTAATCCGGAGAAATACGAAGAAATGGTCAGATTGATGTACCAGGTGGCATATTATTTGGTGCAACCATCTCCTTCTCATGTAACACAGGGT
ACAAATTATTTGGCTCGACTTCTAGTTTTTGTCTATTTCAGGCAGCTCGTCCAGTGGAGTGACCCGTTGCCAGAGTGCAGAGAAATTATTGTCCAGCACTCTATTATTGTACT
GACAATGGAATAATTCAAGGGAACGTGACCATTGACACAGTCTGTGATATAGACAGTTCTGTAACTCCAAGGTCCCACCATGATTCAGAAACTCACAGTAAATGTTCCA
GTGAATAATGATGAAGGAGAGTGGAGTGGCCAGAAAAACCACCAACCACAAATGTTTCCAAGGTACACACGTGTTCCAGGACGATTCAGGAATTAGCATGTGTTT
ACTACAGAAGTCTCACCAAACTTCAGAAAAGGAAGTGAACCACTCAGGTTCTTCATCTCAGGTACTACCCGTCTTCAGGTTGTTTGCTTGTTTTGGGACGTTGGGACGTACTGGAC
CAACCCCAAATAAGGAAGTGAACCACTCAGGTTCTTCATCTCAGGTACTACCCGTCTTCAGGTTGTTTGCTTGTTTTGGGACGTAGTAACCATGTGGGCTTG
CTGACTTAGCCAAAGAAGAGTTAAGAAGAGTTCTTTAAGATGTGTTAGGAATGTCAACACACAAGTATACACACACAAGTCTGTTCCTAGTTTCTGACTTATCTGCAATACATTCTTAGCACCACTCACCTCTTGAAATAGA
TTTAGGATGCTTTCATTGTCTTCATTGTCTTAAGATGTGTTAGGAATGTCAACACACAAGTATACACACACAAGTCTGTTCCTAGTTTCTGACTTATCTGCAATACATTCTTAGCACCACTCACCTCTTGAAATAGA
ACAACTTGCAGAATCTGTAATGTGTATTGTATTCCACTTATAAAGTAAAGCATAGAAAAGCAGTCAAAGTGTTCGTATTTAGAAGTGGATCACGAGGAAAGGAAAGTGATTTTT
CCACAAGATCTGTATGTTGTATTCTTCCACTTATAAAGTAAAGCATAGAAAAGCAGTCAAAGTGTTCGTATTTAGAAGTGGATCACGAGGAAAGGAAAGTGATTTTT
TAAAGAGAGATGAACCACACCATTTGGCTGTAAGGCATTTCATCTTCCTTGGTTGGCAAAATATTTAAAGGTAAAACATGCTGGTGAACCAGGGGTG
TTGATGGTGATAAGGGAATATGAAATATTAACATAAGAAGAAGATTATATATTTCTGAATGAGATGTCCATAGTCAAATTGTAAATCTTATTCTTTTGTAATATTTATTATATT
AAGTATCCAGAGATACTACACATATTAACATAAGAAGAAGATTATATATTTCTGAATGAGATGTCCATAGTCAAATTGTAAATCTTATTCTTTTGTAATATTTATTATATT
TATTTATGACAGTGAACATTCTGATTTACATTGTACATGTAAACGTGACTACTTTCTTGCCAATTACATTTAAGTGTTAGACTAAGACTAAGATGTGTAGACTAAGATGTGTACTAGTGTATAGAATATAACTAGA
ATCATGTAGTATGTGAAATTTATTCTTAAAATTATATATTGTCATCTGTTTAAACGTGACTACTTTCTTGCCAATTACATTTAAGTGTTAGACTAAGATGTGTACTAGTGTATAGAATATAACTAGA
TGAATAATTTCAGCTACTTCAAGTCTACTTTAGGTTTTACCATATCTGTCATCTTGCCAATTACATTTGTCTTCATCTGTTTTGTTGTTGAAGTACTTTAAATTCATCACGTTCATGGCATTTCACTGTAAAGACTTTAATGTGTATTCTTAA
ATTCTAGGTTTTACCATATCTGTCATCTTGCCAATTACATTTGTCTTCATCTGTTTTGTTGTTGAAGTACTTTAAATTCATCACGTTCATGGCATTTCACTGTAAAGACTTTAATGTGTATTCTTAA
TTTATTATGGCAATGTTTATTTTGTTCATTTGCTTCATCTGTTTTGTTGTTGAAGTACTTTAAATTCATCACGTTCATGGCATTTCACTGTAAAGACTTTAATGTGTATTCTTAA
AATAAAACTTTTTTCCTCCTTAA >NP_000565.1 complement decay-accelerating factor isoform 1 preproprotein [Homo sapiens]
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFP
VGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERD
HYGYROSVTYACNKGFTMIGEHSIYCTVNNDEGEWSGPPPECRGKSLTSKVPPTVQKPTTVNVPTTEVSPTSQKTTTKHFHETTPNKGSSGTTSGTTRL
LSGHTCFTLTGLLGTLVTMGLLT

*FIG. 2B*

Fc Linker

>KY053479.1 Synthetic construct Fc-adiponectin gene, complete cds

ATGTACAAGGATGCAACTCCTGTCTTGCATTGCACTAAGTCTTGCACTTGTCACGAACTCGATATCGGCCA
TGGTTAGATCTGACAAACTCACACATCGCCACATGCCCACCGTGCCCAGCACCTGAACTCCTGGGGGGACCGTCAGTCTTCCTCTTCCCCCCAAAACCCAAGGACACCCTCATGA
TCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCA
AGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAG
GTCTCCAACAAAGCCCTCCCAGCCCCCATCGAGAAAACCATCTCAAAGGCCAAAGGGCAGCCCCGAGAACCACAGGTGTACACCCTGCCCCCATCCCGGGAGGAGA
TGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGA
CCACGCCTCCCGTGCTGGACTCCGACGGCTCCTTCTTCCTCTACAGCAAGCTCACCGTGGACAAGAGCAGGTGGCAGCAGGGGAACGTCTTCTCATGCTCCGTGATG
CACGAGGCTCTGCACAACCACTACACGCAGAAGAGCCTCTCCCTGTCTCCGGGTAAAGCCAGCGGAAGTGGCGGTGCGGAGAAGTTGCCTGATGTAT
ACCGTCAGCAGTTCACTGCAACATTCCTGGGCTGTAGACTTCCTGCCTACTACTTTGCCTACCACATCACAGTCTATCCTGCTGCCTCCACCTTGAAGGTGCTATGCT
GGTAAATTCCACTGCAACATTCCTGGGCTGTAGACTTCCTGCCTACTACTTTGCCTACCACATCACAGTCTATCCTGCTGCCTCCACCTTGAAGGTGCTATGCTCT
TCACCTATGATCAGTACGCAGGAGAAATAATGTGGACCAGGCCTGTGTGCTCTTCAGGGCTTTCTGCTTTACCAAGGATGTGAAGGTCAAGGGTAGGCCTATGTCTGCT
GAGCGTAATGGACTCTATGCTGATAATGACAATTGGGACCAGGAAATAATGTGGACCAGGCCTGTGTGCTCTTCAGGGCTTTCTGCTTTACCAAGAAGATGTGAAGGTGCTCCACTG
CCGCTCAGTCAGTTCACTGCAACATTCCTGGGCTGTAGACTTCCTGCCTACTACTTTGCCTACCACATCACAGTCTATGCCTTTACCAAGAAGATGTGAAGGTGCTCCACTG
GTAAATTCCACTGCAACATTCCTGGGCTGTAGACTTCCTGCCTACTACTTTGCCTACCACATCACAGTCTATGCCTTTACCAAGAAGATGTGAAGGTCCTATGATGGCTCCAC
CACCTATGATCAGTACGCAGGAGAAATAATGTGGACCAGGAAATAATGTGGACCAGGCCTGTGTGCTCTTCAGGGCTTTCTGCTTTACCAAGGATGTGAAGGTGCTATGGGAAGGAG
AGCGGTAATGGACTCTATGCTGATAATGACAATTGGGACCAGGAAATAATGTGGACCAGGCCTGTGTGCTCTTCAGGGATCTGGAGAAAGGTGCTATGTATACCGCTCA
GCATTCAGTGTGGACTCTATGCTGATAATGACAATTGGGACCAGGAAATAATGTGGACCAGGCCTGTGTGCTCTTCAGGGATCTGGAGAAAGGTGCTATGTATACCGCTCA
CCACTGCAACATTCCTGGGCTGTACTTTGCCTACCACATCACAGTCTATGCCTTTACCAAGAAGATGTGAAGGTCAGCCTCTTCAAGTATCTTCACCTAT
GATCAGTACCAGGAGAAATAATGTGATAATGACAATTGGGACCAGGAAATAATGTGGACCAGGCCTGTGTGCTCTTCAGGGATCTGGAGAAAGGTGCTATGGGAAGAGCGTA
ATGGACTCTATGCTGATAATGACAATGACACCAACTAA

>Fc Translation

DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQK
SLSLSPGK

*FIG. 3*

Human PD-L1 extracellular domains

>NM_014143.4 Homo sapiens CD274 molecule (CD274), transcript variant 1, mRNA
AGTTCTGCGCAGCTTCCCGAGGCTCCGCACCAGCCGCGCTTCTGTCCGCCTGCAGGGCATTCCAGAAAGATGAGGATATTTGCTGTCTTTATATTCATGACCTACTGGCATTTGCTGAACGCATTAC
TGTCACGGTTCCCAAGGACCTATATGTGGTAGAGTATGGTAGCACATATTAGACACCTGGCACTAATTGTCATTGTGTATGACCTTCAGATCATTGCTGGGAAATGGAGGAT
AAGAACATTATTCAATTTGTGCAGGATGACCTGAGAGGAAGAACTGAAGGTTCAGCTAGTCAGAGAGAACACAATTCCCAGGGACCCGGCTGTTGAAGGTCCCATCATACCTC
GATGTGAAATTGCAGGATGCAGGGGTGTACCGCTGCATGATCAGCTATGGTGGTGACCAAGCCGAATTACTGTGAAAGTCAATGCCACATACTGGACAAGCAGTGACCATCTGGACACAACAACTACTTCGTGCAAAACACCAA
TGGATCCAGTCACCTCTGAACATGAACATGACATGTCAGGCTGAGGGCTACCCACAGCAATGAAAACCATTGAGATTCTTACTGCCATCCTTGCTGCATGAAGAAACCAACCATCTGAATTGGTCATC
GAGAGAACTACCTCTGGCACATCCTCCAAGATACAAACTCCAAAGGAATGGGCCCTGTGGGATGCAGCGGTGACAAGAGGAAGAATGGAACCTGTTAAGGGAAAAGGGGAGAATGATGAA
CCAGAACTACCTCTGGCACATCCTCCAAGATACAAACTCCAAAGGAATGGGCCCTGTGGGATGCAGCGGTGACAAGAGGAAGAATGGAACCTGTTAAGGAAAAGGGAGAATGATGAA
TGTGAAAAAATGTGGCATCCAAGATACAAACTCCAAAGGAATGGGCCCTGTGGGATGCAGCGGTGACAAGAGGAAGAATGGAACCTGTTAAGGAAAAGGGAGAATGATGAA
GTTCATCGGGGCTGAGCGTGACAAGAGGAAGAATGGGCCCTGTGGGATGCAGCGGTGACAAGAGGAAGAATGGAACCTGTTAAGGAAAAGGGAGAATGATGAAGAA
AGATGGAGTCAAACAGGGAGCCTGGAGGAGCTGGAGTTGAGAATCCCTAATTTGAGTCGTGAGGTCTCCAGAGAAGTCCCACTCAATGCCTCCCACTGAATGACACAAGATCATCCAT
TGCTCATCGTAGGAAGGATGAGTTTGCTCACATACTCGGTTGATAACCACTATATTTAAGGAGATTAACCATTTAAGCAATTTAATCGAGTAATTCGGTTGCTCATATTGAGTCTGCATGTGAGGTGCTTGGTCTGTCAGACCTACAGCGTAGCCTAGAGCTAGAGCCAAGCTCAATGTGCATTGCAAAGATGGTGGAAGCAAACAGATTAAGTGCCCTTGCAATATCAGTCCAGGCATTGAATGGGGGAAACCGAGCAGGTTGGACCAAGACCAAAGTACCGTCCT
CAAGGGAGCTCATATGGAGCTATGTATAGTGGGAAACATTTAACAGAGTAATTAATCCTTCATTTACAAAGAGCATGATAAGGATGGTGGTACTGTCTGTCTTTCTATTGCGAAAATAACACTGAAAATAACCCTGAAAATTAAATCTCACCCTTTCTCATGATTCAAATTCAAAATTC
CCAATGTGGTCTGGACGGTTGCCTTTGCAATATCACTATAATCTCCAAGCAACATGTTTCATAGCAACACATAGCTTTCATAATCCAAGACACATAGCTTTCATTATTGTTCTGTGTACTTGCATCTCATCATCTAAAGATAGTGTCTATAAATGCACCAACCACATTGAATTGAAGTTCCCA
ATTTATTCCTGATTTGCCTTTGCAATATCACTATAATCTCCAAGCAACATGTTTCATAGCAACACATAGCTTTCATAATCCAAGACACATAGCTTTCATTATTGTTCTGTGTACTTGCATCTCATCATCTAAAGATAGTGTCTATAAATGCACCAACCACATTGAATTGAAGTTCCCA
AAAAGATCCCAGGGAGGATCCATGCCTCTGTTCTGTTCTTCAAGATTGTTATGTTTCAAGTATATCTTTTCCAGGGTGCACTGGTGTACTTGCAAATCACATTTCTTCTTGCAAATCCGGCAGTATCAGATTTAGAATGCAACCACCATCTGTATGACAGAATCATGTC
GGGCTGAGGATCCATGCCAGAGTTTGGATTTGTTATGTTTCATCTAATATCTTTTCCAGGGTGCACTGGTGTACTTGCAAATCACATTTCTTCTTGCAAATCCGGCAGTATCAGATTTAGAATGCAACCACCATCTGTATGACAGAATCATGTC
GCTCTAGGACAGAGTTTGGATTTGTTATGTTTCATCTAATATCTTTTCCAGGGTGCACTGGTGTACTTGCAAATCACATTTCTTCTTGCAAATCCGGCAGTATCAGATTTAGAATGCAACCACCATCTGTATGACAGAAGCCT
TGGAACTTCGTTTCTGCTGAACCCTGAATGCACCAGCCTGGCTTCATCATCATCATCCAGTCTACACAGCCCTGCTTGCCACAGCCCATTGCAAGGCTACACAGGCACATGCTAGCTGCTGTGCATGTTCTTTCCCTCTGGCCAT
ATTCGTGTGTCAATGACAAGAGAGTACCCTGCAACATCTCTCCACCATGACAAGACTCATCATTGAGGGCTCCTGAAGAAAACAGCATGTCTCTACTCATCCTAAGTCCTAACTCCTGTATCTGCTCAGTACTTTGATTTGTAAGGCACTTTATAATTATCCTTTATCCCTTCTCATGT
TGTCATCGTAAATGGCATAGGCAGAGATGATACCTAATTCGCATTGATTGTCACTTTGTTACCTGCATTAATTAATAAAATATTATTCTTATTTGTACTTGGTACTACAACCAGCAGTGCATCATTGTCATTTCTTG
TTATTTGTGTTTAATAAATGTTCAGTTAACATCCCA >NP_054862.1 programmed cell death 1 ligand 1 isoform a precursor [Homo sapiens]
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKV
NAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRM
MDVKKCGIQDTNSKKQSDTHLEET

*FIG. 4A*

Human PD-L2 extracellular domains

>NM_025239.4 Homo sapiens programmed cell death 1 ligand 2 (PDCD1LG2), mRNA
ACTCTCATGTTACGGCAAACCTTAAGCTGAATGAACCTTTCTTCTCTTGAATATCTTAACGCCAAATTTGAGTGCTTTTTGTTACCCATCCTCATATGTCCCAGCTA
GAAAGAATCCTGGGTTGGAGCTACTGCATGTGATTGTGTTCATTTGGCTGTGTTCAATACAGAACACCTCTATATAAGGAAATCTAACACAAACAGCAACTGTTTTG
TTGTTTACTTTTGCATCTTATTGTGTGGAGCTGTGGCAAGTCCTCACATAATAGAGCATGGCAGTGAATGCAACTTGACCTGGAAGTCAATGTGAACCTTGGA
GCAGCTTATTCACAGTGACAGTTCAAAGGTGGAAAATGATACATCCCCACACCGTGAAAGAGCACTTGCTGGAGGAGCAGCTGCCCTAGGGAAGGCCTCGTTCACAT
GCAATAACAGCCAGTTTGCAAGAGAGGACGAAGGACAGTACAACTTGAAAATCAAAGCTTCTACAGGA
ACCTCAAGTCCAAGTGAGTGAGGGACGAAGGACAGTACAACTGGGTGCCTGGGACTACAAGTACCTGACTGGAAATGTATCTTCCTAACGTCAGCGTTC
AAATAAACACTCACATCCTAAAGGTTCCAGAAACAGATGAGGTACACAGGCTACCTCTGCAGAAGTATCTCGGCCAAACGTCAGCGTTC
CTGCCAACACCAGCACTCAGGACCCCTGAGGCTGCTAACTTATCTGGCCAGATTGGCCAGATGGAACCAGACCATCCAACTTGGCTGCTTCACATTTCATCCCTTCTGCATCATTGCTT
TCAGTGAGGGAACTTACTTGGCCAGCATTGACTTCAAAGTGACAGTGGAACAGATGGTATTCTTCAAAGACAACAACCTGTCACCACACAAAGAGGGAAGTGA
ACAGTGCTATCTGAACTGTGGTCTTGGGATGACAGGCAGAGCCACTTAATGCCTTCAAATGCCTTTAATCGGAAGACCACTTTGAACAAGTCTGAACAAGAATTGCCCCTTCACTGATCTGGACTCACCTG
GAGCCTATGGTTAAGCAAGCACTACTGCCTCAGTTGACATTTACAGATTTCTCCGACCACAGAGGTGTGAAACAGATGGTGCCAATAGAGTTATTATCTATAGCTT
GAATTATTTCCCCTCAAGTTTTCTAAGGTCTATTGAGAGAGGCTATTGAGAGAGGCTATTAACAGAGACATTTAAATATAACACTATAAGCTCTGTTTTGAGGTCTAAGTCACAAAGCATTGTT
AATGAAGTTGTTCTAATTAACAGAGAGCATTTAAATATAACACTGTGAGTCACATCTTCTTTATTGTTTTTGAGGTCTAAGTCACAAAGCATTATACAG
TTAACCTGTATATGGCACCATGTTAATGCGTTTATCTGCACATCGTAAACAGCAATACAGCAATCCTGTAAATTTGCCCCTCTCTTTCTGCCCTCAATATGACTTTA
TCAAAAATATTTGACTTTTCAGTGCCTCAGTTGCCACACATAGTAGTGCAGAATTAAGGCACTGTACAAGGCTAAGACTACTAAATGGCACTACACCACTACATATGT
AATTTGACTTTCAGTGCCTCAGTTGCCACACATAGTAGTGCAGAATTAAGGCTAAGCTGAAATTTGTCTTATACTGGAGCCATGAGCTTGACCTGAACTATTCAAAT
GTGGAGCAGAAGGTAACTCGGCTACAGTAACTTACATAGGTGGGCTAAATCAGAACAAATTTGGGCTTATGAATGAAAGGGTGAAATTGACTAACA
GACAAATCATAACTCCAGTTCTCAATTCTCATGTAAATCAGAGAATAGCCTTTAAAGAAGAATAAAAACTCAACGTTCTTATATATCTTACTTTGGGTA >NP_079515.2 programmed cell death 1 ligand 2 precursor [Homo sapiens]
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTL
KVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCII
AFIFIATVIALRKQLCQKLYSSKDTTKRPVTTTKREVNSAI

*FIG. 4B*

Human CTLA-4 (CD152) extracellular domains

>NM_005214.5 Homo sapiens cytotoxic T-lymphocyte associated protein 4 (CTLA4), transcript variant 1, mRNA
GCTTTCTATTCAAGTGCCTCTGTGTGCACATGTGTACCAAATCTGGGATCAAAGCTATCATATCTGGTTCAAACACATTTCAAAGCTT
CAGGATCTGAAAGGTTTTGCTCTACTTCCTGAAGACCTGAACACCGCTCCCATAAAGCTTGGATTTCAGCGGCACAAGGCTCAGCTGAACCTGGCTA
CAAGAGCCACTCTGCACTCCTGTTTTTCTCTTCTTTGCAAAGCAATGCACGTGGCCCAGCCTGCTGTGGTACTGGCCAGCAGCCGAGGCATC
GCCAGCTTTGTGTGTGAGTATGCATCTCCAGGCAAAGCCACTGAGGTCCGGGTGACAGTGCTTCGGCAGGCTGACAGCCAGGTGACTGAAGTCTGTGCGGCAACCTA
CATGATGGGAATGAGTGACTTGTTCCATCTGCAGGGTCACGGGCACCTCAGTGGAAATCAAGTGAACCTCACTATCCAAGGACTGAGGGCCATGGACACGG
GACTCTACATCTGCAAGGTGGAGCTCATGTACCCACCGCCATACTACCTGGGCATAGGCAACGGAACCCAGATTTATGTGATTGATCCAGAACCGTGCCCAGATTCTG
ACTTCCTCCTCTGGATCCTTGCAGCAGTGTCTTCCGGGTTGTTTTTTATTCAGCCTTATTCTCCACAGCTTGTTTTGAGCAAATGTGTAAAGAAGAAGCCCTTACA
ACAGGGGTCTATGTGAAATGCCCCAACAGAGCCAGAAATGCCAATTCAACTTTGAAAACCATTATTCCAGTGAAGAAGAAGAGAGTCCAT
ATTTCAATTCCAAGAGCTGAGGCAATTCTAACTTTGCTATCCAGTGATACAGAGCTGTATTTGGTGTGTGGGGGAATTCATCTCTTAATATAAAGTTGGATGCGG
AACCCAAATTACGTGTACTACAATTTAAAGCAACAGATGAGTGGGACATCAGCTCCACTTCAGTGAAGAAGGCAGGGAGCAGCCCAAAGAAAAGGTCACAAGAATGGCAGAGCCAGGAATGCCACACAAAAGTGCAGATGGGCACTTAAATTTCAGGAGAAGTTTTCTAGGCTGGCTGGGATAATATGAGCATCAGAAGGTTTATCATATGTTT
TGGGGATGGCAGCATTATGATGGTGATCACGTTTATAGCAGTGATGCTAAAGGTTTTGTGGCTAAAAGGTTTTGTGTATTGCATATACATATAAAACACTATTGGGCCAGCTAAAGGTTTTGTGTATTGCATATACATATAAAACACTATTGGGTTAATGGTTTAATGTGTTAACAACTAGGTCATTTTGCTAACTAGTAGAACACAAGTTCATTTCCTTTCCAAGGAAGCCACACCAATTCCTTCAATAGTTCTGATCTCTACAGGAAGCTCGATGCTGATCATGCTGTAGTGCTTGACTTACACACTGTCTCTGAAGACAAT
TGTTCAGGATAGACAGCCCCCAATTCCTTCAATAGTTCTGATCTCTACAGGAAGCTCGATGCTGATCATGCTGTAGTGCTTGACTTACACACTGTCTCTGAAGACAAT
GGCTTACTCCAGGAGACCCACAGTTGACGTCCGATGAGACCTTCTACAAGAAGTTCCATGAAAACATGTATACAAATACTAAAAAGCAGAAGGGCAGCAGGT
GGCAGAGAATGGGGTGCATGAAGGTTTCTGAAAATTAACACTGTTCTGAAATATTTTAACTCAATATTTTCCATGAAAATGCAACAACATGTATATAATTTTTAATTAAATAAAA
TCTGTGGTGGTCGTTTTCCGGA >NP_005205.2 cytotoxic T-lymphocyte protein 4 isoform CTLA4-TM precursor [Homo sapiens]
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQ
VNLTIQGLRAMDTGLYICKVELMYPPPYYLGIGNGTQIYVIDPEPCPDSDFLLWILAAVSSGLFFYSGLFFYSFLLTAVSLSKMLKKRSPLTTGVYVKMPPTEPECEKQFQPYFIPIN

*FIG. 4C* hCTLA4-Fc-GPI

ATGGCTTGCCTTGGATTTCAGCGGCACAAGGCTCAGTGAACCTGGCTACCAGGACCTGGCCCTGCCACTCTCCTGTTTTTCTTCTTCATCCCT
GTTTCTGCAAAGCCAATGCAATGGCACGTGGCCCAGCTGCTGTGTGGCCTGTACTGCTTCGGGGTCACAGTGCCCAGCTGACAGTGCGAATGAG
GCAAAGCCACTGAGTCCGGGTGACAGTGCTTGGACGGGCACCTGCAGAAATCAAGGTGAACTCTACATGGGCAATGAGCTGAATGAG
TTGACCTTCCTAGATGATTCCATCTGCACGGGCACCTCCAGTGGAAATCAAGTGAACCTACTCTATCCAAGGACTGAGGGCCATGAGGACGGAC
TCTACATCTGCAAGGTGGAGCTCATGTACCCACCGCCATATTACCTGGGCATAGGCAACGGAACCCAGATTTATGTAATTGATCCAGAACCGTGC
CCAGATTCTGACATCGATGACAAAACTCACACATGCCCACCGTGCCCAGCACCTGAACTCCTGGGGGGACCGTCAGTCTTCCTCTTCCCCCCAAA
ACCCAAGGACACCCTCATGATCTCCCGGACCCCTGAGGTCACATGCGTGGTGGTGGACGTGAGCCACGAAGACCCTGAGGTCAAGTTCAACTGG
TACGTGGACGGCGTGGAGGTGCATAATGCCAAGACAAAGCCGCGGGAGGAGCAGTACAACAGCACGTACCGTGTGGTCAGCGTCCTCACCGTC
CTGCACCAGGACTGGCTGAATGGCAAGGAGTACAAGTGCAAGGTCTCCAACAAAGCCCTCCCAGCCCCCATCGAGAAAACCATCTCCAAAGCA
AAGGGCAGCCCCGAGAACCACAGGTGTACACCCTGCCCCCATCCCGGGAGGAGATGACCAAGAACCAGGTCAGCCTGACCTGCCTGGTCAAAG
GCTTCTATCCCAGCGACATCGCCGTGGAGTGGGAGAGCAATGGGCAGCCGGAGAACAACTACAAGACCACGCCTCCCGTGCTGGACTCCGACG
GCTCCTTCTTCCTCTACAGCAAGCTCACCGTGGACAAGAGCAGGTGGCAGCAGGGGAACGTCTTCTCATGCTCCGTGATGCATGAGGCTCTGCAC
AACCACTACACGCAGAAGAGCCTCTCCCTGTCTCCGGGTAAAATCGATCCAAATAAAGGAGGTGAACCACTTCAGTACTACCGTCTCTATCT
GGGCACGTGTTTCACGTTTGCTTGGGACGTTGGCTTGCTGACTAG

MACLGFQRHKAQLNLATRTWPCTLLFFLFLFIPVFCKAMHVAQPAVVLASSRGIASFV
CEYASPGKATEVRVTVLRQADSQVTEVCAATYMGNELTFLDDSICTGTSSGNQVNL
TIQGLRAMDTGLYICKVELMYPPPYYLGIGNGTQIYVIDPEPCPDSDIDDKTHTCPP
CPAPELLGGPSVFLFPPKPKDTLMISRTPEVTCVVVDVSHEDPEVKFNWYVDGVEH
NAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLD
SDGSFFLYSKLTVDKSRWQQGNVFSCSVMHEALHNHYTQKSLSLSPGKIDPNKGSGT
*TSGTTRLLSGHTCFTLTGLLGTLVTMGLLT*

*FIG. 5C* hPDL1-*GPI*-P2A-hHVEM-*GPI*

ATGAGGATATATTTGCTGTGTCTTTATATTCATGACCTACTGGCATTACTGTCACGTTCTGAACGCATTACTGTCACGTTCTGTCACGTTCTGAAGAGTATGGTAG
CAATATGACAATTGAATGAGGAAGACCTGAAGGTTCAGCATATGAAAAACAATTAGACCTGGCTGCACTAATTGTCTATTGGAGAATAAGAACATTATTCAATTTG
TGCATGGAGAGGAAGACCTGAAGGTTCAGCATATGACAGAGACCCGGCTGTTGAAGACCAGCTCTCCCTGGAAATGCTGCACTTCAGATC
ACAGATGTGAAATTGCAGGATGCAGGGGTGTACCTGCTGCATGATGAACTCTCGACTACAAGCGAATTACTGTGAAAGTCAATGCTCCCATACAA
CAAAATCAACCAAGAATTTGGTTGTGAGGCTAAGACATGTCAGGCTGAGCGTACCCAAGGCTACCAAGGCCACACTGAAGTCATCTGACAA
GCAGTGACCATCAAGTCCTGAGTGGTAAGACCACCACCACCAATTCCAAGAGAGGAAAGCTTTTCAATGTGACCAGCACACTGAAGAATCAACACAACA
ACTAATGAGATTTTCTACTGCACTTTTAGGAGATTAGATCCTGAGGAAAACCATACAGCTGAATTGGTCATCCCAGAACTCCTGGCACATCCTCCAAA
TGAAAGGCCAAATAAGGAAGTGGAACCACTTCAGGTACTACCCGTTCTGAAGCAGGCTGCACAGTTTGACAGGTTTGCTTGGGACGCTAGTAA
CCATGGGCCTTGCTCCTCCCTGGAGATCCACCCCACAGCGTCTTGAGGCTGGTGCTGTATCTGAGCGTCTGGTGCCCCCAGCTCTGCC
GTCCTGCAAGGAGACGAGTACCTGGGTGCTGCCACCTCCAAGTGCCCAAGTGGCCTAAGCAAGTGTCTGCAGTTATCTGCAGTGCTGCAGCAAGTGTCTCTGCATCGTGACAAGGGTGACCGCACAG
TGTGTGAACCCTGCCCCTCCAGGACGAGTACCTGCCACCTACATTGCCCACCTCAAAGTCTGCAGCCCCAGAGTAGTGATGGCAGTGACCGCGCG
AGCCGGAACTGCTCCAGGACAGAGAATGCCGTGTGTGGCAGCCCGAGTGGTCAGAAGGAGGCACCAGACCCTGTCTGGACCCCGAGCTGCACCACCTCCAGCCCGGGTTTACAATGGGGCCGCCGCCGCCTTA
CGCCACCTCCAGCCCGGGGCTCAGCAACAGACCAAGACAGAGGTCAGAGGAGCCACCAGAGACCCTGTGTCAGACCAGCAGCACCACCTGGTACCAAATAAAGGAAGTGGA
CCCTGAGGAATGTCAGCACCAGACAAGTGCTCGCAGCCGTTGACAGGTTTGCTTGACACGTGTTTCACGTTGACACACGCTAACCATGGGCTAGTAACCATGGGCTTGCTGACTTAG
ACCACTTCAGGTACTACCCGTCTTCTATCTGGGCACACGTGTTTCACGTTGACACAGGTTTGCTTGACACGTGTAACCATGGGCTTGCTGACTTAG

MRIFAVFIEMTYWHLLNAFTVTVPKDLYVVEYGSNMTIECKFPVEKQLDLAALIVYWEMEDKNIIQFVHGEEDLKVQHSSYRQRARLLKDQLSLGNAALQI
TDVKLQDAGVYRCMISYGGADYKRITVKVNAPYNKINQRILVDPVTSEHELTCQAEGYPKAEVIWTSSDHQVLSGKTTTTNSKREEKLFNVTSTLRINTT
TNEIFYCTFRRLDPEENHTAELVIPELPLAHPPNER *PNKGSGTTSGTTRLLSGHTCFTLTGLLGTLVTMGLLTGSGATNFSLLKQAGDVEENPGMEPPGD
WGPPPWRSTPKTDVLRLVLYLITFLGAPCYAPALPSCKEDEYPVGSECCPKCSSPGYRVKEACGELTGTVCEPCPPGTYIAHLNGLSKCLQCQMCDPAMGLRA
SRNCSRTENAVCGCSPGHFCIVQDGDHCAACRAYATSSPGQRVQKGGTESQDTLCQNCPPGTFSPNGTLEECQHQTKCSWLVTKAGAGTSSSHWV* PNKGSG
*TTSGTTRLLSGHTCFTLTGLLGTLVTMGLLT*

*FIG. 5D* hPDL1-*GPI*-P2A-FGL1-*GPI*

ATGAGGATATATTTGCTGCTGTCTTTATATTCATGACCTACTGGCATTTGCTGCTGAACGCATTACTGCTGCTCACGGTTCCCAAGGACCTATATGTGGTAGAGTATGGTAGC
AATATGACAATTGAATGCAAATTCCCAGTAGAAAACAATTAGACCTGGCTGCACTAATTGTCTATTGGGAAATGGAGGATAAGAACATTATTCAATTTGTG
CATGGAGAGGAAGACCTTGAAGGTCAGAGGATAGTACAGACAGAGGCCCGGCTGTTGAAGGACCAGCTCCCTGGGAAAATGCTCACTTCAGATCACA
GATGTGAAATTGCAGGATGCAGGGGTGTACCGCTGCATGATCAGCTATGGTGTGCCGACTACAAGCGAATTACTGTGAAAGTCAATGCCCCATACAACAAA
ATCAACCAAAGAATTTTGGTTGTGAGGTATGTAAGACATGAACATGAACTCTGAACATGTCAGGCTGCAGGGCTACCCAAGGCCGAAGTCATCTGGACAAGCAGT
GACCATCAAGTCCTGAGTGGTGTAAGACACTTTTAGGAGATTAGATCCTGAGGAAAAACCATACAGCTGAATTGGTCATCCCAGAACTACCTCTGGCACATCCTGCCAATGAAAGG
CCAAATAAAGGAAGTGGAACCACTTCAGTTCTAACCGTCTTGTTTCAGCTACTTCAGCCCTGCTGAAGCAGCGTGACGAGCAGTTTGCTGGGACGTTGAACCATGGGGC
TTGCTGACTGGGAAGCGAGTACAACCCGTCTGTTGCGGCTGCTGAAGCAGCAGCCTCCGAGCGTGTCGCCTCAGTTCGCAGACCCCAGGGCTCAGAGCCCAGGTGCGCCTCGAGACCCGG
GTTACCACCCGCTCTGACAATGGGCAGGAAATTTCGGCGCTCAGGAGGACTGTGCCCAGGAGGACCAGATGAAGTCCAGTTCCTTGATAAAGGAGAATGAAGTCCAGTTCCTTGATAAAGGAGAATCCTCTCCAGAGCAGATGAGCTATCAACCTCTCCAGAGCAGAACTCAAACCCTCCAGCAGAATTCTTCTGTTAT
AGGCAGTATGCAGATTGTTCAGAGATTTTCAATGATGGGTTAATTCAGAGACGATCGTAATTCAGAGACGATCGTAATTCAGAGACGATCTAATTCAGAGACGATCTAATTCAGAGACGATCTAATTCAGAGACGATCTAATTCAGAGACGATGTCCGATGGAGGGAGGATTGAATATTGGCTGGCAATAAATAAGAATTCTTCAAAGTTGGAGATGAATAAAGAATTTCTAAGTGTTGAAATTCTCGAACAGCTGGAGAT
TGTGACATGTCCGATGGAGGGAGGATTGAATATTGGCTGGCAATAAATAAGAATTCTTCAAAGTTGGAGATGAATAAAGAATTTCTAAGTGTTGAAATTCTCGAACAGCTGGAGAT
TCCCTTGCGCAGAAGAGATCAGTCTGGTACACCTGGGCATGGTGGTCGTGGTTAACAGGTCGTATTCCTGAAATCTGTGAAATCTGAAAATCTGAAACCTGAATGGTGTATACTACAGCGCCCTACACGGCCTAAAACAACAT
GGGATTGTCTGGTACACCTGGGCATGGTGGTCGTGGTTAACAGGTCGTATTCCTGAAATCTGTGAAATCTGTGAAATCTGAAATCTGTATATTAGGCCAAATGATTTATTCCAAATGTAATTCAAATGTAATTCAAAATAAA
GGAAGTGGAACCACT*TCAGTTGCTGTGGACGCTAGTAACCATGGGCTTGCTGACT*
TAG

MRIFAVFIFMTYWHLLNAFTVTVPKDLYVVEYGSNMTIECKFPVEKQLDIAALIVYWEMEDKNIIQFVHGEEDLKVQHSSYRQRARLLKDQLSLGNAALQIT
DVKLQDAGVYRCMISYGGADYKRITVKVNAPYNKINQRILVDPVTSEHELTCQAEGYPKAEVIWTSSDHQVLSGKTTTTNSKREEKLFNVTSTLRINTTTN
EIFYCTFRRLDPEENHTAELVIPELPLAHPPNER*PNKGSGTTSGTTRLLSGHTCFTLTGLLGTLVTMGLLTGSGATNFSLLKQAGDVEENPGMAKVFSFIL*
VTTALTMGREISALEDCAQEQMRLRAQVRLLETRVKQQQVKIKQLLQENEVQFLDKGDENTVIDLGSKRQYADCSEIFNDGYKLSGFYKIKPLQSPAEFSVY
CDMSDGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGD
SLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI *PNK*
*GSGTTSGTTRLLSGHTCFTLTGLLGTLVTMGLLT*

*FIG. 5E* hPDL1-GPI

ATGAGGATATATTGCTGTCTTTATATTCATGACCTACTGGCATTTGCTGTCACGGTTCCCAAGGACCTATATGTGGTAGAG
TATGGTAGCAATATGACAATTGAATGCAAATTCCCAGTAGAAAAACAATTGACCTGGCTGCACTAATTGTCTATTGGGAAATGGAGGATAAG
AACATTATTCAATTTGTGCATGGAGAGAAGACCTGAAGTTCAGCAGATAGTACAGACAGAGGGCCCGGCTGTTGAAGGACCAGCTCTCC
CTGGGAAATGCTGCACTTCAGATCAATGCCCCATACAACAAAATCAACCAGTGAAATTTGGTTGTGAACATGAACATGTACAAG
CGAATTACTGTGAAAGTCTGAGGGCTACCCCAAGCCAATTCATCTGGACAAGTCATCTGAGTGGTAAGACCTGAGTGGTAAGAACCACCACCAATTCCAAGACA
CAGGCTGAGGGCTACCCCAAGCTTTTCAATGTGACCAGCACACTGAGAATCAACACAACCACCTCTGCACATTCCAGAACTTTTCTACTGCACTTTTAGGAGATTAGATCCTGAG
GAAAACCATACAGCTGAATTGGTCATCCCAGAACTACCTCTGCACATCCTCCAAATGAAAGCCAAATAAGGAAGTGGAACCATGCTGACTTCAGGT
ACTACCCGTCTTCTATCTGGGCACACGTGTTTTCACGTTGCTTGCTTGACAGGTTTGCTCTTGACACGTCCTAGTAACCATGGGCTTGCTGACTTAG

FIG. 5F

MRIFAVFIFMTYWHLLNAFTVTVPKDLYVVEYGSNMTIECKFPVEKQLDLAALIVYWEMEDKNIIQFVHGEEDLKVQHSSYRQRARLLKDQLS
LGNAALQITDVKLQDAGVYRCMISYGGADYKRITVKVNAPYNKINQRILVVDPVTSEHELTCQAEGYPKAEVIWTSSDHQVLSGKTTTTNSKR
EEKLFNVTSTLRINTTTNEIFYCTFRRLDPEENHTAELVIPELPLAHPPNER*PNKGSGTTSGTTRLLSGHTCFTLTGLLGTLVTMGLLT* hPDL1-Fc-GPI

ATGAGGATATATTTGCTGTGTCTTTATATATTCATGACCTACTGGCATTTGCTGAACGCATTACTGTCACGGTTCCCAAGAGACCTATATGTGGTAGAGTATGGTAG
CAATATGACAATTGAATGCAAATTCCCAGTAGAAAACAATTAGACCTGGCTGCACTAATTGTCTATTGGGAAATGGAGGATAAGAACATTATTCAATTTG
TGCATGGAGAGGAAGACCTGAAGGTTCAGGCAGTTGCAGGGTGCCGGCTGCTCTCCCTGGAAATGCTGCACTTCAGATC
ACAGATGTGAAATTGCAGGATGCAGGGGTGTACCGGTACATGTGCCGACTACAGCGAATTACTGTGAAAGTCAATGCCCATACAA
CAAAATCAACCAAGAATTTGGTTGTGGATCCACCTCAGCTGAACATGAACATGAAGAGAAGCTTTTCAATGTGACCACTGAGAATCAACACAACA
GCAGTGACCACCATCAAGTCCTGAGTGGTAAGACACCACCACCAAATTCCAAGAGAGAACCATACAGCTGAATTGTCATCCCAGAACTACCTCTGGCACATCCTCCAAA
ACTAATGAGATTTTCTACTGCACTTTTAGGAGATTAGATCCTGAGGAAAACCATAGATCCTGAGGAAAACCATAGCTGAATTGTCATCCCAGAACTACCTCTGGCACATCCTCCAAA
TGAAAAGGAATCGATGACGACAAACTCACACATGCCCACCGTTGTTCTCCTGTCTTCCCCCCAAAACCAAGGACA
CCCTCATGATCTCCCGGAGACACCCTGAGGTGCGTGGTGGATGCGGAGGATACCCTGAGGTCAAGTTCAACTGGTACGTGGACGGCGTGGAG
GTGCATAATGCCAAGACAAAGCCGCGGGAGGAGCAGTACAACAGCACGTACCGTGTGGTCAGCGTCCTCACCGTCCTGCACCAGGACTGGCTGAATGGCAA
GGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCC
TGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAAT
GGGCAGCCGGAGAACAACTACAAGACCACGCCTCCCGTGCTGGACTCCGACGGCTCCTTCTTCCTCTACAGCAAGCTCACCGTGGACAAGAGCAGGTGGCA
GCAGGGGAACGTCTTCTCATGCTCCGTGATGCATGAGGCTCTGCACAACCACTACACGCAGAAGAGCCTCTCCCTGTCTCCGGGTAAAATGATCCAAATA
AGGAAGTGGAACCACTTCAGGTACTACCCGTCTTCAGTGATCGTGTCGGACAGGTTTGCTTGGGACGCCTAGTAACCATGGGCTTGCTG
ACTTAG

MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQI
TDVKLQDAGVYRCMISYGGADYKRITVKVNAPYNKINQRILVVDPVTSEHELTCQAEGYPKAEVIWTSSDHQVLSGKTTTNSKREEKLFNVTSTLRINTT
TNEIFYCTFRRLDPEENHTAELVIPELPLAHPPNERIDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESN
GQPENNYKTTPPVLDSDGSFFLYSKLTVDKSRWQQGNVFSCSVMHEALHNHYTQKSLSLSPGKIDPNKGSGTTSGTTRLLSGHTCFTLTGLLGTLVTMGLL
T

*FIG. 5G* hPDL2-Fc-GPI

ATGATCTTCCTCCTGCTAATGTTGAGCCTGGAATTGCAGCTTCACCAGATAGCAGCTTTATTCACAGTGACAGTCCCCTAAGGAACTGTACATAATAGAGCAT
GGCAGCAATGTGACCCTGGAATGCAACTTTGACACTGGAAGTCATGTGGAGCAATAACAGCCAGTTTGCAAAAGTGGAAAATGATACATCCCA
CACCGTGAAAGAGCCACTTTGCTGAGGAGCAGCTGCCCCCTAGGGAAGGCCCTCGTTCCACATACCTCAAGTCCATAGGAAATAAACACTCACATCCTAAAGGTTCCAGAAACA
ATAATCATCTATGGGGTCGCCTGGGACTACAAGTACCTGACTCTGAAAGTCAAAGTTCTACAGAGAAATAAACACTCACATCCTAAAGGTTCCAGAAACA
GATGAGGTAGAGCTCACCTGCCAGGTACACAGTGTTATCCTCTGGCCAAAGTGTCAGCTGTCCTGCCAACACGTCAGCCACTCCAGGACCCCT
GAAGGCCTCTACCAGTGCACCAGTTGTCGCCTAAAGCCACCCCCTGGCAGAAACTTCAGTGTGTTCTGGAATACTCACGTGAGGGAACTTACTTTG
GCCAGCATTGACCTTCAAAGTCAGATGAACCCAGGAACCCAGGAACCTGAACCTCAAACATCCTGGGG
GGACCGTCAGTCTTTCCTCTTCCCCCCAAAACCCAAGGACACACCCTCATGATCTCCCGGACCCCTGAGGTCACATGCGTGGTGGTGGACGTGAGCCACGAAGAC
CCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGC
GTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAA
GCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTC
TATCCCAGCGACATCGCCGTGGAGTGGGAGAGCAATGGGCAGCCGGAGAACAACTACAAGACCACGCCTCCCGTGCTGGACTCCGACGGCTCCTTCTTCCTC
TACAGCAAGCTCACCGTGGACAAGAGCAGGTGGCAGCAGGGGAACGTCTTCTCATGCTCCGTGATGCATGAGGCTCTGCACAACCACTACACGCAGAAGAGC
CTCTCCCTGTCTCCGGGTAAATGATCGATCCAAATAAGGAAGTGGAACCACTTCAGTACCCGTCTTCTATCCGGGCACACGTGTTTCACGTTGACAGT
TTGCTTGGGACGCTAGTAACCATGGGCCTTGCTGACTTAG

MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQC
IIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTL
ASIDLQSQMEPRTHPTIDDKTHTCPPCPAPELLGGPSVFLFPPKPKDTLMISRTPEVTCVVVDVSHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFL
YSKLTVDKSRWQQGNVFSCSVMHEALHNHYTQKSLSLSPGKIDPNKGSGTTSGTTRLLSGHTCFTLTGLLGTLVTMGLLT

*FIG. 5H* hPDL1-C1C2

ATGAGGATATATTGCTGTCTTTATATTCATGACCTACTGGCATTTGCTGAACGCATTACTGTCACGGTTCCCAAGGACCTATATGTGGTAGAGTATGGTAG
CAATATGACAATTGAATGCAAATTCCCAGTAGAAATACAATTGCCACTAATTGTGTCTATTGGAGGATAAGAGGATAAGGAGAACATTATTCAATTTG
TGCATGGAGAGGAAGACCTGAAGGTTCAGCATAGTACAGACAGAGGGCCCGGCTGTTGAAGGACCAGCTCTCCCTGGGAAATGCTGCACTTCAGATC
ACAGATGTGAAATTGCAGGATGCAGGGGTGTACCGCTGCATGATCAGCTATGGTGTGCCGACTACAGCGAATTACTGTGAAAGTCAATGCCCATACAA
CAAAATCAACCAAGAAATTTGGTTGTGGTAAGACCCTCTGAACATGAACATCTCAGGCTGAGGGCTACCCCAAGGCTGAAGTCATCTGGACAA
GCAGTGACCAAGTCCTGAGTGGTAAGACCACCAACCAATTCAAGAGAGAAGAAGCTTTTCAATGTGACCAGCACTGAGAATCAACACACA
ACTAATGAGATTTTCTACTGCACTTTTAGGAGATTAGATCCTGAGGAAAACCATACAGCTGAATTGGTCATCCCAGAACTCCTGGCACATCCTCCAAA
TGAAAGGATCGATGTCGAGCCACTGGGCATGGAGAATGGCAATGGCAATTGCCAACTCACAGATCGCCGCCAACTCGTGCGTGCACCTTCTTGGGTTTGCAGC
ATTGGGTCCCGGAGCTGGCCCCGCTGGAACCTGGTGCCAGCCAGTGTCAATGCCCAGCAATGTTCATTGTCAGACACCCTGGACCATAACCCCTGGATCCAGGTGAACCTGCTG
CGGAGGATGTGGGTACAGGTGTGGTCAGGGATGTGGCAGGGTGCCAGGGTGCCGAGATAGTACCTCAAGGTGCCTACAGCAGCCTTAATGGACA
CGAATTCGATTTCATCCATGATGTTAATAAAAAAACACAAGGAGTTTGTGTGGGTAACAACCGGGTGGGCTTCAACCTGTTTGAGACCCCTGTGG
AGGCTCAGTACGTGAGATTGTACCCACAGCTGCCCACGAGCTGCCACACGGCCCTCCAGCAGCTACAAGACCTGGGGCTTGCATCTCTTCAGCTGCAACGCCGAACGTGAACGCGCAATCCCTG
GGCCTGAAGAATAACAGCATCCCTGACAAGCAGATCACGGCCTCCAGCAGCTACAAGACCTGGGGCTGCATCTCTTCAGCTGCAACTCCTATGCACG
GCTGGACAAGCAGGGCAACTTCAACGCCTGGGTTGCGGAGCTACGGTAACGATCAGTGCCGCCTCTAGCCTGGGCACACAACGCCCCTGGCAACACTCCCACA
AGAAGAACTTGTTTGAGACGCCCATCCCGCCTATGTGCGCATCCTGGCTATGTGCGCATCCTCCGCTGAGCCCCTGAGGAGCTGCTGCTGGGCTGT
TAG

MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQI
TDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTT
TNEIFYCTFRRLDPEENHTAELVIPELPLAHPPNERIDVEPLGMENGNIANSQIAASSVRVTFLGLQHWVPELARLNRAGMVNAWTPSSNDDNPWIQVNLL
RRMWVTGVTQGASRLASHEYLKAFKVAYSLNGHEFDFIHDVNKKHKEFVGNWNKNAVHVNLFETPVEAQYVRLYPTSCHTACTLRFELLGCELNGCANPL
GLKNNSIPDKQITASSSYKTWGLHLFSWNPSYARLDKQGNFNAWVAGSYGNDQWLQIFPGNWDNHSHKKNLFETPILARYVRILPVAWHNRIALRLELLGC

*FIG. 5I* hPDL2-C1C2

ATGATCTTCCTCCTGCTAATGTTGAGCCTGGAATTGCAGCTTCACCAGATAGCAGCTTTATTCACAGTGACAGTCCCTAAGGAACTGTACATAATAGAGCA
TGGCAGCAATGTGACCCTGGAATGTAACTTTGACACTGGAAGTCATGTGGGAAGCAATAACAGCCAGTTGCAAAAGTTGGAAAATGATACATCCC
CACACCGTGAAAGAGCCACTTTGCTGGAGGAGCAGCTCGCCCTAGGGAAGGCCTGCTTCCACATACCTCAAGTCAAGTGAGGACAGTACCAA
TGCATAATCATCTATGGGGTCGCCCTGGGACTACAAGTACCTGACTCTGAAAGTCAAAGCTTCCTACAGAAAATAAACACTCACATCCTAAAGGTTCCAGA
AACAGATGAGGTAGAGCCTCACCTGCCCAGGCTACAGGTTATCCTCTGGCAGAAGTATCCTGCCAAACGTCAGCGTTCCTGCCAACACCAGCCACTCCAGGA
CCCCTGAAGGCCTCTACCAGTGTTCTGCGCCACCAGTCAGATCAGATGAACCAGAACCCATCCAACTATCGATGTCGAGCCACTGGGCACTCC
ACTTTGGCCAGCAGCATTGACCTTCAAAGTCAGATGGAACCAGAACCCATCCAACTATCGATGTCGAGCACCTGGGCATGTCGAGCCACTGGCCACTC
ACAGATCGCGCCTCATCTGCGCTGTGTAACCCCTGGATCCAGTGAACCTGCGGAGGATGTGGGTAACAGGTGTGGTGACGCAGGTGCCAGCGCTTGGCCAGT
CACCCAGCAGCAATGACGATAAACCCCTGGATCAGTGAACCTGCGGAGGATGTGGGTAACAGGTGTGGTGACGCAGGTGCCAGCGCTTGGCCAGT
CATGAGTACCTGAAGGCCTTCAAGGTGGCCATGTCGAGCGAATTCATCGATTCATCCATGATTGTACCCCGAGACTGAGATTCTGAGATTGTAATAAAAACACCTGCCACGGCGCCTGCACTCTGC
CTGGAACAAAAACGCGGTGCATGTCGAGCTGTGAGCTGTCAACCTGTTCTGAGACCCCTGTGGAGGCTCAGTACGACTGGCCACAGAATAACAGCATCCCCTGAAGAACGCCTGGTTGCGGGGAGCTACGGTAACGA
GCTTTGAGCTACTGGGCTTGCATCTCTTCCCTGGCAACTGGGACAACTGGGACTGGAACCCTCCTATGCCAACGCCCATCCTGCCTCTGCTATGTGCGCATCCTGCCTG
AAGACCTGGGGCTTGCAGATCTTCCCTGGCAACTGGGACAACTGGGACTGGAACCCTCCACAGAAGAACTTGTTTGAGACGCCCATCCTGCCTCTGCTATGTGCGCATCCTGCCTG
TCAGTGGCTGGACAACCGCCATCGCCGCCCTGCGCGCCTGGAGCTGCTGGGCTGTTAG

MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQ
CIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVREL
TLASIDLQSQMEPRTHPT*IDVEPLGMENGNIANSQIAASSVRVTFLGLQHWVPELARLNRAGMVNAWTPSSNDDNPWIQVNLLRRMWVTGVVTQGASRLAS
HEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSY
KTWGLHLFSWNPSYARLDKQGNFNAWVAGSYGNDQWLQIFPGNWDNHSHRKNLFETPILARYVRILFVAWHNRIALRLELLGC

*FIG. 5J*

4F2-h41BBL

ATGAGCCAGGACACCGAGGTGGATATGAAGGAGGTGGAGCTGAATGAGTTAGAGCCCGAGAAGCAGCCCATGTCCCTG
GCGGGAGCCGAGAAGAACGGGCTGATCGTGAAGATCAAGGTGGCGGAAGACGAGGCAGAGTTCACGGCCGTGTCCAAGGAGGAGCTG
CTGAAGGTGGCCTGCCCCCGGCCCGTGTCCAGGAGGCATGTGTTCGCGAGGGCCCTGCCCGGCTGGCCCTGAGACTCCGGAGCTGCATA
ATCGTGGCCTGCCCCTGGGCCGTGTCCGGGGCATGTGTTCGCGAGGGCCATGTGTTGCTACTATGCTCTTTCAACTAGAGCTG
GCCGGCCCTCTTGGGACCTGCGCGGCAGGAGGCCTGAGCTCAGGCTGTGGTGGCCAACTGCGCTCTGCTGGGGCCCGGCCTGAGCTG
GCAGGCGTGTCCCTGACGGGCGTGGCTGGCGAGGCTACAAAGAGGACACGAAGAGCTGGTGGTGGCCAACTGCAGCCTGTCTTCAACTAGAGCTG
CGGCGCGGTGGTGCCGGCGAGGGCTCCCGAGCTCAGGCTCCTCCGAGCTCAGGCTCTCACTTGCGCTGCACCTGCGCTCTGCTGGGGCCCGGCCTGAGCTG
GACCTGCCACCCGCCTCCTCCGAGGCCAGCTGCCATGCGCCAGGGCCACGCCCCGAAATCCGAGTGACCCCCCGAAATCCCAGCCCGACTCCCTTCACCG
ACTGAGGCCAGGGCACGCCAGGGCCATGCGCCAGGCTCTACCCAGCCTTACCCAGCCTGGCAGGCCCGAGCCGAGTGACCCCCCGAAATCCCAGCCCGACTCCCTTCACCG
AGTCGGAATAA

MSQDTEVDMKEVELNELEPEKQPMNAASGAAMSLAGAEFKNGLIVKIKVAEDEAEAAAAKFTGLSKEELLKVAGSPGWVRTRWALLLLFWLGWLGMLAGAVVI
IVACPWAVSGARASPGSAASPRLREGPELSPDDPAGLLDLRQGMFAQLVAQNVLLIDGPLSWYSDPGLAGVSLTGGLSYKEDTKELVVAKAGVYVFFQLEL
RRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSP
RSE

*FIG. 5K* hPDL1-4Fc-GPI

ATGAGGATATATTGCTGTCTTTATATTCATGACCTACTGGCATTTGCTGAACGCATTACTGTCACGGTTCCCAAGGACCTATATGTGGTAGAGTATGGTAG
CAATATGACAATTGAATGCAAATTCCCAGTAGAAAAACAATTAGACCTGGCTGCACTAATTGTCTATTGGAGGATAAGAACATTATTCAATTTG
TGCATGGAGAGAGGAAATTGAAGGTTCAGCAGATGCAGGGGTGCAGGTTCAGCATAGTACAGACAGAGAGCCCGGCTGTTGAAGACCAGCTCTCCTGGAAATGCTGCACTTCAGATC
ACAGATGTGAAGTTGCAAGATGCAGGGGTGTACCGCTGCATGATCAGCTATGGTGGTGCCGACTACAAGCGAATTACTGTGAAAGTCAATGCCCCATACAA
CAAAATCAACCAAAGAATTTTGGTCTGCAGTGGTTGTGAAGCATGTGAACGAAAGCATGTGAACTGACATGTGAACTGAACATGAGAGAAGCTTTTCAATGTGACCACTGACAGAATCAACACAACA
GCAGTGACCAAGTCCTGAGTGCTTTAGGAGATTAGATCCTGAGGAAAAACCATACAGCTGAATTGGTCATCCAGAACTGGTCATCCTGGCACATCCTCCAAA
ACTAATGAGATTTTCTACTGCTTTAGGAGATTAGATCCTGAGGAAAAACCATACAGCTGAATTGGTCATCCAGAACTGGTCATCCTGGCACATCCTCCAAA
TGAAAGG GAGTCCAAATATGGTCCCCAAATATCATGCCCACATCAGTCTTCCTGTTCCCCCAAAACCAAGGACA
CTCTCATGATCTCCGGACCCCTGAGGTCACGTGCGTGGTGGTGGACGTGAGCCACGAAGACCCGAGGTCAAGTTCAACTGGTACGTGGATGGCGTGGAG
GTGCATAATGCCAAGACAAAGCCGCGGGAGGAGCAGTTCAACAGCACGTACCGTGTGGTCAGCGTCCTCACCGTCCTGCACCAGGACTGGCTGAACGGCAA
GGAGTACAAGTGCAAGGTCTCCAACAAAGGCCTCCCAGCCCCCATCGAGAAAACCATCTCCAAAGCCAAAGGGCAGCCCCGAGAGCCACAGGTGTACACCC
TGCCCCCATCCCGGGATGAGCTGACCAAGAACCAGGTCAGCCTGACCTGCCTGGTCAAAGGCTTCTACCCCAGCGACATCGCCGTGGAGTGGGAGAGCAAT
GGGCAGCCGGAGAACAACTACAAGACCACGCCTCCCGTGCTGGACTCCGATGGCTCCTTCTTCCTCTACAGCAAGCTCACCGTGGACAAGAGCAGGTGGCA
GGAGGGGAATGTCTTCTCAGTACTTCACCCGTGTTGCTGGGGACAGTTTGCTCCGGGTAACCATGGGCCTTGCTGACTTAG
GTTGAACCACTTCAGGTACCATGAGCCCGTCTTCTATCGCGACAGTTTCACGTGTTTCACGTGTTTGCTCCGGGTAACCATGGGCCTTGCTGACTTAG

*MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQI*
*TDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTT*
*TNEIFYCTFRRLDPEENHTAELVIPELPLAHPPNERESKYGPPCPSCPAPEFLGPSVFLFPPKPKDTLMISRTPEVTCVVVDVSQEDPEVQFNWYVDGVE*
*VHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESN*
*GQPEDNYKTTPPVLDSDGSFFLYSRLTVDKSRWQEGNVFSCSVMHEALHNHYTQKSLSLSPGK*PNKGSGTTSGTTRLLSGHTCFTLTGLLGTLVTMGLLT

FIG. 5L

Myr-NanoLuc Luciferase

ATGGGGTTGCTGTGTTTCTCCAAGACCGGCTCGAGCGGCGTCTTCACACTCGAAGATTTCGTTGGGACTGGGCGACAGACAGCCGGCTACAACC
TGGACCAAGTCCTTGAACAGGAGGTGTCTCCAGTTTGTTTCAGAATCTCGGGGTGTCCGTAACTCCAAAGGATTGTCCTGAGCGG
TGAAAATGGGCTGAAGATCGACATCCATGTCATCATCCCGTATGAAGGTCTGAGCGGCCAGATGGGCCAGATCGAAAAATTTTAAG
GTGGTGTACCCTGTGGATGATCATCACTTTAAGGTGATCCTGCACTATGGCACACTGTAACAGGACCCTGTGGAACGGCAACAAATTATCGA
ATTTCGGACGGCCCGTATGAAGGCATCGCCGTGTTCGACGGCAAAAAGATCACTGTAACAGGACCCTGTGGAACGGCAACAAATTATCGA
CGAGCGCCTGATCAACCCCGACGGCTCCCTGCTGTTCCGAGTAACCATCAACGGAGTGACCGGCTGCCGCTGTGCGAACGCATTCTGGCG
TAA

MGCCFSKTGSSGVFTLEDFVGDMRQTAGYNLDQVLEQGVSSLFQNLGVSVTPIQRIVLSGENGLKIDIHVIIPYEGLSGDMQIEKIFK
VVYPVDDHHFKVILHYGTLVIDGVTPNMIDYFGRPYEGIAVFDGKKITVTGTLWNGNKIIDERLINPDGSLLFRVTINGVTGWRLCERILA

*FIG. 5M*

Myr-mScarlet

ATGGGTTGCTGTTTCTCCAAGACCGGCTCCAGCGGCGTGAGCAAGGGCGAGGCAGTGATCAAGGAGTTCATGCGGTTCAAGGTGCACATGGAG
GGCTCCATGAACGGCCACGAGTTCGAGATCGAGGGCGAGGGCGAGGGCCGCCCCTACGAGGGCACCCAGACCGCCAAGCTGAAGGTGACCAAG
GGTGGCCCCCTGCCCTTCTCCTGGGACATCCTGTCCCCTCAGTTCATGTACGGCTCCAGGGCCTTCACCAAGCACCCCGCCGACATCCCCGAC
TACTATAAGCAGTCCTTCCCTGAGGGCTTCAAGTGGGAGCGCGTGATGAACTTCGAGGACGGCGGCGTGGTGACCGTGACCCAGGACACCTCC
CTGGAGGACGGCACCCTGATCTACAAGGTGAAGCTCCGCGTCAACTTCCCTCCTGACGGCCCCGTAATGCAGAAGAAGACAATGGGCTGG
GAAGCGTCCACGGAGCGGTTGTACCCCGAGGACGGCGTGCTGAAGGGCGACATTAAGATGGCCCTGCGCCTGAAGGACGGCGGCCGCTACCTG
GCGGACTTCAAGACCACCTACAAGGCCAAGAAGCCCGTGCAGATGCCCGGCCTACAACGTCGACCGCAAGTTGGACATCACCTCCCACAAC
GAGGACTACACCGTGGTGGAACAGTACGAACGCTCCGAGGGCCGCCACTCCACCGGCCATGGACGAGCTGTACAAG

MGCCFSKTGSSGVSKGEAVIKEFMRFKVHMEGSMNGHEFEIEGEGEGRPYEGTQTAKLKVTKGGPLPFSWDILSPQFMYGSRAFTKHPADIPD
YYKQSFPEGFKWERVMNFEDGGAVTVTQDTSLEDGTLIYKVKLRGTNFPPDGPVMQKKTMGWEASTERLYPEDGVLKGDIKMALRLKDGGRYL
ADFKTTYKAKKPVQMPGAYNVDRKLDITSHNEDYTVVEQYERSEGRHSTGGMDELYK

*FIG. 5N* hSecPDL1-GPI

ATGAGGATATTTGCTGTCTTTATATTCATGACCTACTGGCATTTGCTGAACGCATTAGCTGCTCACGGTTCCCAAGGACCTATATGTGGTAGAGTATGGTAGC
AATATGACAATTGAATGCAAATTCCCAGTAGAAAACAATTAGACCTGGCTGCACTAATTGTCTATTGGGAAATGGAGGATAAGAACATTATTCAATTTGTG
CATGGAGAGGAAGACCTGAAGGTTCAGGATATGCAGACAGAGCCCGGCTGTTGAAGGACCAGCTCTCCCTGGGAAATGCTGCACTTCAGATCACA
GATGTGAAATTGCAGGATGCAGGGGTGTACCGCTGCATGATCAGCTATGGTGGTGCCGACTACAAGCGAATTACTGTGAAAGTCAATGCCCCATACAACAAA
ATCAACCAAAGAATTTTGGTTGTGGATCCAGTCACCTCTGAACATGAACCTCCAAGAGGAGAGAACAGCCTACCCAGGTCATCTGGACAAGCAGT
GACCATCAAGTCCTGAGTGGTAAGACCACCACCACCAATTCCAAGAGAGAGAAACCATACAGCTGAATGACCACACTGAGAATCAACACAACAACTAAT
GAGATTTTCTACTGCACTTTTAGGAGATTAGATCCTGAGGAAAACCATACCCAGGTAATATTCTGAATGTGTCCATTAAAATATGT
CTAACACTGTCCCCTAGCACCCCAAATAAAGGAAGTGGAACCACTTCAGGTACTACCCGGTCTCTTCATCTGGGCACACGTGTTTCACGTTGACAGGTTTGCTT
*GGGACGCTAGTAACCATGGGCTTGCTGACTTAG*

MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQIT
DVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTN
EIFYCTFRRLDPEENHTAELVIPGNILNVSIKICLLTLSPST *PNKGSGTTSGTTRLLSGHTCFTLTGLLGTLVTMGLLT*

*FIG. 50*

Tfr2-h41BBL

ATGGAGCGGCTTTGGGGTCTCTATTCCAGAGAGCGCAACAACTGTCCCCAAGATCCTCTCAGACGTCGTGTGAAGCCCCCGAAAGGGCACCTGG
AGGAGGAAGAGGAAGACGGGGAGGAGGGGCGGAGACATTGGCCCCCACTTCTGCCCCTGAGCCCCTGGCTCTAGACCCCAGGCAGCC
AAACCTCATTCCCTGGGCGGCAGCAGGACGGAGGGCTGCCCCCTGGTCCTGACGGCCCCTGATCTTCACTGGGCCTTCCTACTGGGCTACGTCGCC
TTCCGAGGTCCGCCTTGCCCTGCCCGTGTCCGGGCCGTCTCCGCGACTCCGCGAGCTCCGCGAGCTTTCGCCCGACG
ATCCCGCCGGCCTCTTGGACCTGCCGCAGGGCATGTTTGCGCAGCTGGTGGCCCAAAATGTTCTGCTGATCGATGGGCCCTGAGCTGGTACAGTGACCAGG
CCTGGCAGGCGGTGTCCCTGAGCCCCTGACGGGGGCCCTGAGCTACAAAGAGGACTACAAAGAGGAGCTGGTGTGGGCCACCTGGCTCTACTATGTCTTCTTTCAACTAGAG
CTGCGGGGCCGTGGTGGCCCGGCGAGGGCTCAGGCTGCCTCCGTTTCACTTGGCGCTGACCTGCAGCCTGGAGCCGCCCCTGCCCCTGGCTTTGACCG
TGGACCTGCCACCCCGCCCTCCCGAGGCTCGGAACTCGGACTCGGCAGCTGGACGCTCTTGGACTCTTCGGTGACCCCGAAATCCCAGCCCGACTCCCTTCACCG
CACTGAGGCCAGGCCACGCACGCCATGCCAGGCACTTACCCAGGCAGCTTACCCAGGGCGCCACAGTCTTGGACTCTTCGGGTGACCCCGAAATCCCAGCCCGACTCCCTTCACCG
AGGTCGGAATAA

MERLWGLFQRAQQLSPRSSQTVYQRVEGPRKGHLEEEEDGEEGAETLAHFCPMELRGPEPLGSRPRQPNLIPWAAAGRRAAPYLVLTALLIFTGAFLLGIYVA
FRGSACPWAVSGARASPGSAASPRLRGPELSPDDPAGLLDLRQGMFAQLVAQNVLLIDGPLSWYSDPGLAGVSLTGGLSYKEDTKELVVAKAGVYVFFQLEL
RRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPR
SE

*FIG. 5P*

CD9tm3-h41BBL

ATGGGCTGCTGCGGGGCTGTGCAGGAGTCCCAGTGCATGCTGGGACTGTTCTTCGGCTTCCTCTTGGTGATATTCGCCATTGAAATAGCT
GCGGCCATCTGGGGATATTCCCACAAGGATGAGGCCTGCCCTGTGCCTGGGGCTTCCGGGGACCTTCGCCCCGAGCTTCCGGCCAGCCCG
AGACTCCGCGAGGGTCCCGAGCTTTCGCCCGACGATCCCGGGCCTGCGGCAGGGCATGTTTGCGCAGCTGGTGGCCCAA
AATGTTCTGCTGATCGATGGGCTGGTGTGGCCCTGAGCTGGTGTACAGGCCCTGAGCTGTCCCTGCAGGCGCCTGAGCGGGGCCTGAGTCTCCCTGAGCTACAAAGAG
GACACGAAGGAGCTGGTGGCCAAGGCTGGAGTCTACTATGTCTTCTTCCAACTAGAGCTGCGGCGCGTGGTGGCCGGAGAGGGCTCA
GGCTCCGTTTCACTTGCCGTGCACCTGCAGCCACCTCGGCTTCTTCCAGGCGCCCTGAGTGCCGCCTGACCGTGCCGCCTGGCCGCCTGCCATCTTCACACT
GAGGCCAGGGCACGCATGCCTGGCAGCTTACCCAGGCCCACAGTCTTGGGACTCTTCCGGGTGACCCCGAAATCCCAGCCGGACTC
CCTTCACCGAGGTCGGAATAA

MGCCGAVQESQCMLGLFFGFLLVIFAIEIAAAIWGYSHKDEACPWAVSGARASPGSAASPRLREGPELSPDDPAGLLDLRQGMFAQIVAQ
NVLLIDGPLSWYSDPGLAGVSLTGGLSYKEDTKELVVAKAGVYYVFFQLELRRVVAGEGSGSVSLALHLQPLRSAAGAAALALTVDLPPA
SSEARNSAFGFQGRLLHLSAGQRLGVHLHTEARARHAWQLTQGATVLGLFRVTPEIPAGLPSPRSE

*FIG. 5Q*

Myr/Palm-4F2-h41BBL

ATGGGTTGCTGTTTCTCCAAGACCGGCTCGAGCGGCAGCCAGGACACCGAGGTGGATATGAAGGAGGTGGAGCTGAATGAGTTAGAGCCCGAGAAGCAGCCGA
TGAACGCGGCGGTCTCGGGCGGCAGCGCCATGTCCCTGGGCGCGGAGAAGAACGGGCTCGTGAAGATCAAGGTTGAAGATGAAGACGAGGCGGAGGCGGCCGC
TAAGTTCACGGGCCTGTCCAAGGAGGAGCTGCTGAAGGTCGTGGCCGGCTCGCCGGGCTGGGTACGCACCCGCTGGGCCCTCCGCGGCCTCGCAGCCCGAGACTCCGCG
CTCGGCATGCTTGCTGCTGGTGCCGTGGTCATAATCGTGGCCTGTCCGCAGGGCATGTTTGCGCAGCTGCAGGTCAGCGACCCGGGCCTGGGCGTGTCCGACCCGCTGAGC
AGGGTCCCGAGCTTTCGCGAGCTTACAGTGACCAGCCTGACCGAGCTACAAAGAGGACTACAAAGAAGGAGCTGGTGGTGGCCAAGCTGGAGTC
CCTGAGCTGGTACAGTGACCAGCCTGACCGAGCTACAAAGAGGACTACAAAGAAGGAGCTGGTGGTGGCCAAGCTGGAGTC
TACTATGTCTCTTTCTTTCAACTAGAGCTTTGACCGTGGACTGCGATTCACTTGCCGCTGTCCTTTCCAGCGCTCGCCTTCCAGGGCCGTTGGACTGCCGG
GGGCCGCCGCCTGGGCTTTGACCGTGCCATCTTCACACTGAGCCGGCCTTACCCAGGGCCGCCAGCTCTTGGGACTCTTCCGGTGACCCCCGAA
CCAGCGCCTGGGCGTCCATCTTCACACTGAGCCGGCCTTACCCAGGGCCGCCAGCTCTTGGGACTCTTCCGGTGACCCCCGAA
ATCCCAGCGCCGACTCCCTTCACCGAGGTCGGAATAA

MGCCFSKTGSSGSQDTEVDMKEVELNELEPEKQPMNAASGAAMSLAGAEKNGLVKIKVAEDEAEAAAAKFTGLSKEELLKVAGSPGWVRTRWALLLFWLGW
LGMLAGAVVIIVACPWAVSGARASPGSAASPRLREGPELSPDDPAGLLDLRQGMFAQLVAQNVLLIDGPLSWYSDPGLAGVSLTGGLSYKEDTKELVVAKAGV
YVYFFQLELRRVAGEGSGSVSLALHLQPLRSAAGAAALALTVDLPPASSEARNSAFGFQGRLLHLSAGQRLGVHLHTEARARHAWQLTQGATVLGLFRVTPE
IPAGLPSPRSE

*FIG. 5R*

Myr/Palm-Link-41BBL

ATGGGTTGCTGTTTCTCCAAGACCGGCTCGAGCGGCTGGGCCCTGGTCGCGGGGCTGCTGCTGCTGCTGCTGCTGGCCGCC
TGCCCCTGGGCCGTGTCCGGTGCGCAGGGCATGTTTGCGCAGCTGGTGGCCCAAAATGTTCTGCTGATCGATGGGCCCCTG
TTGGACCTGCGCCAGGGCATGTTTGCGCAGCTGGTGGCCCAAAATGTTCTGCTGATCGATGGGCCCCTGAGCTGGTACAGTGACCCAGGCCTGGCAGGCGTG
TCCCTGACGGGGGCCTGAGCTACAAAGAGGACACGAAGGAGCTGGTGGTGGCCAAGGCTGGTAGTCTTCTTTCAACTAGAGCTGCGGGCGTG
GTGGCCGGCGAGGGCTCAGGCTCCGTTTCACTTGCGCTGCACCTGCAGCCACTGCGCTCGCCCCTGGCTTTGACCGTGACCTGCCA
CCCGCCTCCTCCGAGGCTCGAAACTCGGCTTGTTCCAGGGCCCGCGTTGCACCTGAGTGCCGGTCCATCTTCACACTGAGGCC
AGGGCACGCCATGCCTGGCACTTACCCAGGCGCCACAGTCTTTGGACTCTTTCCGGGTGACCCCCGAAATCCCAGCCGACTCCCCTTCACCGAGGTCGAA
TAA

MGCCFSKTGSSGWALVAGLLLLLLLLAAACAVFLACPWAVSGARASPGSAASPRLREGPELSPDDPAGLLDLRQGMFAQLVAQNVLLIDGPLSWYSDPGLAGV
SLTGGLSYKEDTKELVVAKAGVYVFFQLELRRVVAGEGSGSVSLALHLQPLRSAAGAAALALTVDLPPASSEARNSAFGFQGRLLHLSAGQRLGVHLHTEA
RARHAWQLTQGATVLGLFRVTPEIPAGLPSPRSE

*FIG. 5S* hPDL1-Link-GPI

ATGAGGATATATTTGCTGCTGTCTTTATATTCATGACCTACTGCATTTGCTGAACGCATTACTGTCACGGTTCCCAAGGACCTATATGTGGTAGA
GTATGGTAGCAATATGACAATTGAATGCAAATTCCCAGTAGAAAAACAATTAGACCTGGCTGCACTAGAGAGACCTGTTCTATTGGGAAATGGAGGATA
AGAACATTATTCAATTTGTGCATGGAGAGAACCTGAAGGTTCAGGATCTACAGACAGAGGGCCCGGCTGTTGAAGGACCAGCTC
TCCCTGGGAAATGCTGCACTTCAGATCACAGATGTGAAATTGCAGGATGCAGGGGTGTACCGCTGCATGATCAGTCAGTCAGTCCGACTA
CAAGCGAATTACTGTGAAAGTGCCCCATACAGCCCCAGGCCGAATCATCGACAAGTCAGTGACCATCAAGTCCTGAGTGGTAAGACCACCACCTCC
CATGTCAGGCTGAGGGCTACCCCAAGGCTACCCCAAGCCGAATCATCTGACAAGTCAGTGACCATCAAGTCCTGAGTGGTAAGACCACCACCTCC
AAGAGAGGAGAAGCTTTTCAATGTGACCAGCACACTGAGAATCAACACAACTAATGAGATTTTCTACTGCACTTTTAGGAGATTAGA
TCCTGAGGAAAACCATACAGCTGAATTGGGCTCGAGCGGCCCAAATAAGGAACCACTTCAGGTACTCAGGTACTACCCGTCTTCTATCTGGGC
ACACGTGTTTCACGTTGACAGGTTGCTTGGGACGCTTAGTAACCATGGGCTTGCTGACTTAG

MRIFAVFIFMTYWHLLNAFTVTVPKDLYVVEYGSNMTIECKFPVEKQLDLAALIVWEMEDKNIIQFVHGEEDLKVQHSSYRQARLLKDQL
SLGNAALQITDVKLQDAGVYRCMISYGGADYKRITVKVNAPYNKINQRILVDPVTSEHELTCQAEGYPKAEVIWTSSDHQVLSGKTTTTNS
KREEKLFNVTSTLRINTTTNEIFYCTFRRLDPEENHTAEL*GSSGPNKGSGTTSGTTRLLSGHTCFTLTGLLGTLVTMGLLT*
*ACRVFHVDRLLGRLALDL*

*FIG. 5T* hSecPDL1-CD9tm2

ATGAGGATATATTTGCTGTCTTTATATATTCATGACCTACTGGCATTTGCTGAACGCATTACTGTCTCACGGTTCCCAAGGACCTATATGTGGTAGAGTATGGTA
GCAATATGACAATTGAAATTGCAAATTCCCAGTTCAGAGAAAACAATTAGACCTGGCTGCACTAATTGTCTATTGGGAAATGGAGGATAAGAACATTATTCAATT
TGTGCATGGAGAGGAAGACCTGAAGGTTCAGGTATAGCACAGACAGAGGGCCCCGGCTGTTGAAGGACCAGCTCTCCCTGGGAAATGCTGCACTTCAG
ATCACAGATGTGAAATTGCAGGATGCAGGGGTGTACCGCTGCATGATCAGCTATGGTGCCGACTACAAGCGAATTACTGTGAAAGTCAATGCCCAT
ACAACAAAATCAACCAAAGAATTTGGTTGTGATCCAGTCACCTCTGAACATGAACTGACATGTCAGCTGAGGGCTACCCCAAGGCCGAAGTCATCTG
GACAAGCAGTGACCATCAAGTCCTGAGTGGTAAGACCATCCACCACCAATTCCAAGAGAGGAGAAGCTTTTCAATGTGACCACACTGAGAATCAAC
ACAACAACTAATGAGATTTTCTACTGTCCCCTAGCACCTCTACACAGGAGTCTATATCTCTATATTCTGAATGTGT
CCATTAAAATATGTCTAACACTGTCCCCTAGCACCTTCTACACAGGAGTCTATATATTCTGATCGGAGCCCGGCGCCCTCATGATGCTGGTGGGCTTCCTGGGG
*CTGCTGCGGGCTGTGCAGGAGTCCCAGTGCTAG*

MRIFAVFLFMTYWHLLNAFTVTVPKDLYVVEYGSNMTIECKFPVEKQLDLAALIVYWEMEDKNIIQFVHGEEDLKVQHSSYRQRARLLKDQLSLGNAALQ
ITDVKLQDAGVYRCMISYGADYKRITVKVNAPYNKINQRILVVDPVTSEHELTCQAEGYPKAEVIWTSSDHQVLSGKTTTTNSKREEKLFNVTSTLRIN
TTTNEIFYCTFRRLDPEENHTAELVIPGNILNVSIKICLTLSPST *FYTGVYILIGAGALMMLVGFLGCCGAVQESQC*

*FIG. 5U* hSecPDL1-CD9tm2-KRAS

ATGAGGATATATTTGCTGCTGTCTTTATATTCATGACCTACTGGCATTTGCTGAACGCATTACTGTCACGGTTCCCAAGGACCTATATGTGGTAGAGTATGGTAGC
AATATGACAATTGAATGCAAATTCCCAGTAGAAAAACAATTAGACCTGGCTGCACTAATTGTCTATTGGGAAATGGAGGATAAGAACATTATCAATTTGTG
CATGAGGAGAGAAGACCTGAAGGTTCAGCATAGTACAGAGACACAGAGCCCGGCTGTTGAAGACCAGCTCTCCCTGGAAATGCTGCACTTCAGATCACA
GATGTGAAATTGCAGGATGCAGGGTGTACCGCTGCATGATCAGCTATGGTGGTGCCGACTACAAGCGAATTACTGTGAAAGTCAATGCCCATACAACAAA
ATCAACAACAAAGAATTTGGTTGTGGATCAACCTCTGAACATGACTGAGCTTCAGGCTGAGGGCTACCCAAGGCCGAAGTCATCTGACAAGCAGT
GACCATCAAGTCCTGAGTGGTAAGACACCACCACCATCCAAATTCCAAGAGAGAAGCTTTTCAATGAACACCACTGACCATGACACCAACAACTAAT
GAGATTTTCTACTGCACTTTTAGGAGATTAGATCCTGAGGAAAACCATACAGCTGAATTGGTCATCCCAGGTAATATTCTGAATGTGTCCATTAAAATATGT
CTAACACTGTCCCCTAGCACCTTCTACACAGGAGTCTATATTCTGATCGGAGCCGGCGCCCTTGGGCTTCCTGGCTGTGCGGGGCTGTG
CAGGAGTCCCAGTGCAAATGCAAAAAAGAAGAAAAAAAGAAGTCAAAGACAAGTGTGTAATTATGTAA

MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQIT
DVKLQDAGVYRCMISYGGADYKRITVKVNAPYNKINQRILVVDPVTSEHELTCQAEGYPKAEVIWTSSDHQVLSGKTTTNSKREEKLFNVTSTLRINTTTN
EIFYCTFRRLDPEENHTAELVIPGNILNVSIKICLTLSPST *FYTGVYILIGAGALMMLVGFLGCCGAVQESQCKKKKKSKTKCVIM*

*FIG. 5V* hSecPDL1-CD9tm4

ATGAGGATATATTTGCTGTCTTTATATTCATGACCTACTGGCATTTGCTGTGAACGCCATTACTGTCACGGTTCCCAAGGACCTATATGTGGTAGAGTATGGTAG
CAATATGACAATTGAAATGCAAAATTCCCAGTAGAAACAATTAGACCTGCTGCACTAATTGTCTATTGGGAGATAAGGAGGATAAGAACATTATTCAATTTG
TGCATGATGAGAGGAAGAGACCTGAAGGTTCAGCATAGTAGCTACAGAGAGGGCCCGGCTGTGTTGAAGGACCAGCTCTCCCTGGGAAATGCTGCACTTCAGATC
ACAGATGTGAAATTGCAGGATGCAGGGGTGTACCGCTGCATGATCAGCTATGGTGGGGCCGACTACAAGCGAATTACTGTGAAAGTCAATGCCCATACAA
CAAAATCAACCAAGAATTTGGTTGTGAGTGGTAAGACCACCACCAATTCCAAGAGAGAGAAGCTTTTCAATGTGACCAGCACACTGAGAATCAACACAACA
GCAGTGACCATCAAGTCCTGAGTGGTAAGACCACCACCAATTCCAAGAGAGAGAAGCTTTTCAATGTGACCAGCACACTGAGAATCAACACAACA
ACTAATGAGATTTTCTACTGTCCCCTAGCACCATCGGCGCAGTGTCATCATTTGGCATATTGCCGTGGTGGTCATTGCCAGTAATATTCTGAATGTGTCCATTAA
AATATGTCTAACACTGTCCCCTAGCACC*ATCGGCGCAGTGTCATCATTTGGCATATTGCCGTGGTGGTCATTGCCAGTAATATTCTGAATGTGTCCATTAA*
*CTATCCGCAGGAACCGCGAGATGGTCTAG*

MRIFAVFIFMTYWHLLNAFTVTVPKDLYVVEYGSNMTIECKFPVEKQLDLAALIVWEMEDKNIIQFVHGEEDLKVQHSSYRQRARLLKDQLSLGNAALQI
TDVKLQDAGVYRCMISYGGADYKRITVKVNAPYNKINQRILVDPVTSEHELTCQAEGYPKAEVIWTSSDHQVLSGKTTTTNSKREEKLFNVTSTLRINTT
TNEIFYCTFRRLDPEENHTAELVIPGNILNVSIKICLTLSPST*IGAVGIGIAVVMIFGMIFSMILCCAIRRNREMV*

*FIG. 5W* hSecPDL1-CD81

ATGAGGATATTTGCTGTCTTTATATTCATGACCTACTGGCATTTGCTGAACGCATTTACTGTCGAAGTTCCCAAGGACCTATATGTGGTAGAGTATGGTAGCAATAT
GACAATGAATGCAAATTCCCAGTAGAAAAACAATTAGACCTGGCTGCTCTGATTGTCTATTGGGAAATGGAGGATAAGAACATTATTCAATTTGTGCATGGAGAGG
AAGACCTGAAGGTTCAGCATAGTTCATACAGACAGAGGGCCCGGCTGTTGAAGGACCAGCTCTCCCTGGAAATGCTGCACTTCAGATCACAGATGTGAAATTGCAG
GATGCAGGGGTGTACCGCTGCATGATCAGCTATGGTGGTGCCGACTACAAGCGAATTACTGTGAAAGTCAACAAAATCAACCAAGAATTTTGGT
TGTGGATCCAGTGCACCTCTGAACATGAACTGAGGCTCAGGCTGACATGTCAGGCCGAAGTCATCTGGACAAGCAGTGACCATCAAGTCCTGAGTGGTAAGA
CCACCACCAATTCCAAGAGAGAGGAAGCTTTTCAATGTGACCAGCACACTGAGAATCAACACAACTAATGAGATTTTCTACTGCACCTTTTAGGAGATTA
GATCCTGAGGAAAACCATACAGCTGAATTGGTCATCCCAGTAATATTCTGAATGTGTCCATTAAAATATGTCTAACACTGTCCCCTAGCACCCTGTACCTCATCGG
CATTGCTGCTGCCATCGTCGCTGTGATGATCATGATCTTCGAGATGATCCTGAGCATGGTGCTGTGCTGTGGCATCCGGAACAGCTCCGTGTACTGA

MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQ
DAGVYRCMISYGGADYKRITVKVNAPYNKINQRILVVDPVTSEHELTCQAEGYPKAEVIWTSSDHQVLSGKTTTNSKREEKLFNVTSTLRINTTNEIFYCTFRRL
DPEENHTAELVIPGNILNVSIKICLTLSPSTLYLIGIAAIVVAVIMIFEMILSMVLCCGIRNSSVY

*FIG. 5X* hCD200-Fc-GPI

ATGGAGAGGCTGGTGATCAGGATGCCCTTCTCTCATCTGTCTACCTACAGCCCTGGTTTGGGTCATGGCAGCAGTGGTGCTGTGCACAGCACAAGTGCAAGTGGTGAC
CCAGGATGAAAGAGAGCAGCTGTACACACCTGCTTCCTTAAAATGCTCTCTGCAAAATGCCCAGGAAGCTCTCATTGTGACATGGCAGAAAAAGAAAGCTGTAAGCC
CAGAAAACATGGTCACCTTCAGCGAGAACATGGTGATCGTGATCCAGCCTGCCTATAAGGACAAGATAAACATTACCCAGCTGGGACTCCAAAACTCAACCATCACC
TTCTGGAATATCACCCTGGAGGATGAAGGTGTTACATGTGTCTCTTCAATACCTTTGGTTTTGGCCACTGCCCTGCCTCACCGTCTATGTACAGCC
CATAGTATCCCTTCACTACAGTGACTCTGTCTGCACCAGTCTTCTGAAGACCAGATCTGAAGAACCTCCATATCAAAGACCTCATGAAGTGGGGAAGGAGGTGATCTGC
TTGAAAATAGTACAGGACTCTGCCTGGATCTCACCCAAATGGGACCAGTCTTCAACCAAGGCAAAACCGTCAACAAAGGCATCGATGACAAAAACTCACAGAGTCCCCCCAAAAACCCAAGGACACCCTCTTCCCCCCAAAACCCAAGGACACCCTCTCC
CAGGTGCTGCCACTGGGGGCTCTCTTCCCCCCAAAACCCAAGGACACCCTCATGATCTCCCGGACCCCTGAGGTCACATGCGTGGTGGTGGACGTGAGCCACGAAGACCCTG
AGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACC
GTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCC
CCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCG
TGGAGTGGGAGAGCAATGGGCAGCCGGAGAACAACTACAAGACCACGCCTCCCGTGCTGGACTCCGACGGCTCCTTCTTCCTCTACAGCAAGCTCACCGTGGACAAG
AGCAGGTGGCAGCAGGGGAACGTCTTCTCATGCTCCGTGATGCATGAGGCTCTGCACAACCACTACACGCAGAAGAGCCTCTCCCTGTCTCCGGGTAAAATCGATCC
AAATAAAGGAAGTGGAACCACTTCAGGTACTACCCGTCTCTTCTTCAGGTGTTTCACGTTGTTTGCTTGGGACGCTAGTACGCTGTAACCATGGGCTTGCTGA
CTTAG

MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTIT
FWNITLEDEGGCYMCLFNTFGFGKISGTACLTVYVQPIVSLHYKFSEDHLNITCSATARPAPMVFWKVPRSGIENSTVTLSHPNGTTSVTSILHIKDPKNQVGKEVIC
QVIHLGTVTDFKQTVNKGIDDKTHTCPPCPAPELLGGPSVFLFPPKPKDTLMISRTPEVTCVVVDVSHEDPEVKFNWYVDGVEVHNAKTKPREEQYNSTYRVVSVLT
VLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGKIDPNKGSGTTSGTTRLLSGHTCFLTLGLLGTLVTMGLLT

*FIG. 5Y* hFGL1-GPI

ATGGCAAAGGTGTTCAGTTTCATCCTTGTTACCACCGCTCTGACAATGGGCCAGGAGCAGATGCGGCTCA
GAGCCCAGGTGCGCCTGCTTGAGACCCGGGTCAAACAGCAGGTCAAGATCAAGCAGCTTTTGCAGGAGAATGAAGTCCAGTTCCTTGATAAGGAGA
TGAGAATACTGTCAGTCTTGAAGCAAGAGCAGTATGCAGATTGTTCAATGATGGGTATAAGCTCAGTGGATTTTACAAAATCAAA
CCTCTCCAGAGCCCAGCAGAATTTCTGTTTATTGTGAAATGGCTTTGAAATCGACCTTGCAGATTTTGAAAAAAATAGCCGTTATGCACAATATAAGATTTCAAAGTTGGAGATGAAAAGAATTTCTAC
ACAGAGGATGGAAAGACTACACTTTAAAAATCGACCTTGCAGATTTTGAAAAAAATAGCCGTTATGCACAATATAAGATTTCAAAGTTGGAGATGAAAAGAATTTCTAC
AGAAGACTACACTTTAAAAATCGACCTTGCAGATTTTGAAAAAAATAGCCGTTATGCACAATATAAGATTTCAAAGTTGGAGATGAAAAGAATTTCTAC
GAGTTGAATATTGGGACAGAGATATTCTGGAACAGCTATGACAACTATGCGCGGGAATTCCCTTGCCGAGAAGATCAGTCTGGCTGCTGGTTTAACAGGTGTCACTCTGAAATCTGTGGTTATG
TCAGCACGTGGGACTACACGGCCCCTACACGGCTAAAACAGCAATGGGATTGTCTGGTACACCTGGGTGGTGCATGGGTACTACCCCGTCTTCTATCTGGGCACACGTGTTTCA
AAAATTAGGCCAAATGATTTTATTCCAAATGTAATTCCAAATAAAGGAAGTGAACCACTTCAGGTACTACTCCCGTCTTCTATCTGGGCACACGTGTTTCA
CGTTGACAGGTTTGCTTGGGACGCTAGTAACCATGGGCTTGCTGACTTAG

FIG. 5Z

MAKVFSFILVTTALTMGREISALEDCAQEQMRLRAQVRLLETRVKQQQVKIQLLQENEVQFLDKGDENTVIDLGSKRQYADCSEIFNDGYKLSGFYKIK
PLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFY
ELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVM
KIRPNDFIPNVI PNKGSGTTSGTTRLLSGHTCFTLTFGLLGTLVTMGLLT hGal9-Fc-GPI

ATGGCCTTCAGCGGTTCCCAGGCTCCTTACCTGAGTCCAGCTGTCCCCTTTTCTGGGACTCAGGAGGACTTCAGATCACTGTCAATGGGACC
GTTCTCAGCTCCAGTGGAACCAGGTTTGCTGTGAACTTTCAGACTGGGGAAATGACATTGCCTTCCACCCTCGGTTTGAAGATGAGGTACGTG
GTGTGCAACACGAGGCAGAACGGAAGCTGGGGGCCCGAGGAGAGACTTCCAGAAGGGGATGCCCTTTGACCCTTCGTCTGCTTCCTGGTGCAGAGCTCA
GATTTCAAGGTGATGGTGAACGGGATCCTCTTCGTGCAGTACTTCCACCGTGTGCCGTTCCACCGGTGTGGACAGTGTCTGTTCCCCAGGCTCTGTGCAGCTGTCCTAC
ATCAGCTTCCAGAACCCCGCTGCCCGGCTGTGGCCTATCCGCACCCCGATGCCTTTCATCACCATTGGGAGGCTGTACCATTCTGGACAGATGTTTCTCAGGCACTGTCGTCAGTGCTCAG
ATGTACCCCCACATCAACCTGTGCTCTGGGAACCACATCGCCTTCCACCTGAACCCCCGTTTGATGAGAATGCTGTGTCTCAGTGGATCGACAACTCCTGGGGG
AGTTCCACATCAACCTGTGCTCTGGGAAAAAATGCCCTTCGTCCCGCCAGAGCTTCTGTGTTGTGGATCTTTGTGTGAAGCTCACTGCCTCAAGGTGCCGTGATGGTCAG
CACCTGTTTGAATACTACCATCGCCTGAGGAACCTGCCCACCATCAACCGCCTCAGGAACCTGCCCACCATCAACCGCCTCAGGAACCTGCCCAACATCAGCTTCCTGTATTCCAAACTCACCGTGGACAAGAGCCGCTGGCAGCAGGGCAATGTGTTCAGCTGCAGTGTGATGCATGAGGCTCTGCACAACCACTATACTCAGAAGAGCCTCTCCCTGTCTCCGGGTAAATGA

*MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSS DFKVMVNGILFVQYFHRVFHRVDTISVNGSVQLSYISEQNPRTVPVPQPAFSTVPFSQPVCFPPRPRGRRQKPPGVWPANPAPITQTVIHTVQSAPGQMFSTPAIPPM MYPHPAYPMPFITTILGGLYPSKSILLSGTVLPSAQRFHINLCSGNHIAFHLNPRFDENAVRNTQIDNSWGSEERSLPRKMPFVRGQSFSVWILCEAHCLKVAVDGQ HLFEYYHRLRNLPTINRLEVGGDIQLTHVQTIDDKTHTCPPCPAPELLGGPSVFLFPPKPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGS FFLYSKLTVDKSRWQQGNVFSCSVMHEALHNHYTQKSLSLSPGKIDPNKGSGTTSGTTRLLSGHTCFTLTGLLGTLVTMGLLT*

FIG. 5AA hCD200-GPI

ATGGAGAGGCTGGTGATCAGGATGCCCTTCTCTCATCTGTCTACCTACAGCCTGGTTTGGGTCATGGCAGCAGTGGTGCTGTGCACAGCACAAGTGCAAGT
GGTGACCCAGGATGAAAGAGAGAGCAGCTGTGTACACACATGCCTGCTTCCTTAAATGCTCTCTGCAAAATGCCCAGGAAGCCCTCATTGTGACAGTGGCAGAAAAAGA
AAGCTGTAAGCCCAGAAACATGGTCACCTTCAGCGAGAACATGGTGTGATCCAGCCGTGCCTATAAGGACAAGATAAACATTACCCAGCTGGACTC
CAAAACTCAACCATCACCTTCTGGAATATATCACCCTGGAGGATGAAGGGTGTTACATGTGTCTCTTCAATACATTTGGTTTGGAAGATCTCAGGAACGGC
CTGCCTCACCGTCTATGTACAGCCCATAGTATCCCTTCACTACAAATTCTCTGAAGACCACCTAAATATCACTGCTCTCGCACTGCCCCAGCCCCA
TGGTCTTCTGGAAGGTCCCTCGGTCAGGATTGAAAATAGTAGTACAGTCTGTCTCACCCAGACCACGTCTGTTACCAGCATCCTCCATATCAAA
GACCCTAAGAATCAGGTGGGGAAGGAGGTGATCTGCCAGGTCTGATCGGGACACGTGTTCACGTTTCACGTTGCTGACAGTGGACACGTGTTCACGTTGCTGCTTAAGCAAACCGTCAACAAAGGCCCAAATAAAGG
AAGTGGAACCACTTCAGGTACTACCCGTCTTCTATCTGGGACACGTGTTCACGTTTCACGTTGCTGACAGTGGACGCTAGTAAGCTAGTAACCATGGCCTTGCTGACTT
AG

MERLVIRMPFSHLSTYSLVWVMAAVVLCTAQVQVTQDEREQLYTPASLKCSLQNAQEALIVTWQKKKAVSPENMVTFSENHGVVIQPAYKDKINITQLGL
QNSTITFWNITLEDEGCYMCLFNTFGFGKISGTACLTVVVQPIVSLHYKFSEDHLNITCSATARPAPMVFWKVPRSGIENSTVTLSHPNGTTSVTSILHIK
DPKNQVGKEVICQVLHLGTVTDFKQTVNKG*PNKGSGTTSGTTRLLSGHTCFTLTGLLGTLVTMGLLT*

*FIG. 5BB* hGal9-GPI

ATGGCCTTCAGCGGCTCCCAGGCTCCCTACCTGAGTCCAGCTGTCCCCTTTTCTGGGACTATTCAAGGAGGTCTCCAGGACGGACTTCAGATCACTGTCAATGGGACC
GTTCTCAGCTCCAGTGGAACCAGGTTTGCTGTGAACTTTCAGACTGGCTTCAGTGAAAATGACATTGCCTTCCACTTCAACCCTCGGTTTGAAGATGGAGGTACGTG
GTGTGCAAACACGAGGCAGAACGGAAAGCTGGGGGCCCGAGGAGAGAAGACACACATTCCAGAAGGGGATGCCCTTTGACCTCTGCTTCCTGGTGCAGAGCTCA
GATTTCAAGGTGATGGTGAACGGGATCCTCTTCGTGCAGCTCCCTGTTTCAGCGTTCAGCCTTCCCCACCGGTGGACACCTGTGTTTCCCAGCTGCTCTGTGCAGCTGCCTAC
ATCAGCTTCCAGAACCCCCGGACCGTGCCTGCCAACCGGCTCCCATTACCCAGACAGTCATCACAACCGAGAGCGCCCTGAGTGTTCTCTACTCCCGCCATCCCACCTATG
CCTCCGGCGTGTGGGCCTATGCCCGCCTATCGATGCCTTTCATCACCACCATTCTGGGAGGGCTGTACCCATTCTGGCCCACCTCCTGTCCTGCCCAGTGCTCAG
AGTTCCACATCAACCTGTGCTCTGGGAACCACATCGCCTTCCACCTGAACCCCCGTTTGATGAGAATGCTGTGGTCCGCAACACCCAGATCGACAACTCCTGGGG
TCTGAGGAGCGAAGTCTGCCCCGAAAATGTCTGCTTCCTCCGTGGCCAGAGCTTCTCAGTGTGGATCTTGTGTGAAGCTCACTGCCTCAAGGTGGCCGTGGATGGTCAG
CACCTGTTTGAATACTACCACCGGCTACTACTGGGACACACGTGTTTCACGTTGACAGGTTTGCTGGTGGACGCTAGTAACCATGGGACTGCTGCTGACTTAG
GGAACCACTTCAGGTACTACCGGCTACTACTGGGACACACGTGTTTCACGTTGACAGGTTTGCTGGTGGACGCTAGTAACCATGGGACTGCTGCTGACTTAG

MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSS
DFKVMVNGILFVQYFHRVDTISVNGSVQLSYISFQNPRTVPVQPAFSTVPFSQPVCFPPRPRGRRQKPPGVWPANPAPITQTVIHTVQSAPGQMFSTPAIPPM
MYPHPAYPMPFITTILGGLYPSKSILLSGTVLPSAQRFHINLCSGNHIAFHLNPRFDENAVRNTQIDNSWGSEERSLPRKMPFVRGQSFSVWILCEAHCLKVAVDGQ
HLFEYYHRLRNLPTINRLEVGGDIQLTHVQT PNKGSGTTSGTTRLLSGHTCFTLTGLLGTLVTMGLLT

*FIG. 5CC* hHVEM-GPI

ATGGAGCCTCCTGGAGACTGGGGGCCTCCTCCCTGGAGATCCACCCCCAAAACCGACGTCTTGAGGCTGGTGCTGTATCTCACCTTCCTGGG
AGCCCCCTGCTACGCCCCAGCTCTGCGCCTCCTGCAAGGAGGAGACGAGTACCCAGTGGGCTCCGAGTGCTGCCCCAAGTGCAGTCCAGTTATC
GTGTGAAGGAGGCCTGCGGGGAGCTGACGGGCACAGTGTGTGAACCCTGCCCTCCAGGCACTTACATTGCCCATCTAAATGGCCTAAGCAAG
TGTCTGCAGTGCCAAATGTGTGACCCAGCCATGGGCCTCCGAGCGCGAACTGCTCCAGGACAGAGAACGCCGTGTGTGGCTGCAGCCC
AGGCCACTTCTGCATCGTCCAGGACGGGACCACTGCGCCGTGCCACTCCAGGGGCCAGAGGGTGCAGAAGGGAG
GCACCGAGAGTCAGGACACCCTGTGTCAGAACTGCCCCCCGGGACCTTCTCTCCCAATGGGACCCTGGAGGAATGTCAGCACCAGACCAAG
TGCAGCTGGCTGGTGACGAAGGCCGGAGCTGGGAGCAGCAGCTCCCACTGGGTACCAAATAAAGGAAGTGGAACCACTTCAGGTACTACCCG
TCTTCTATCTGGGCACACAGTGTTTCACGTTGACAGGTTTGCTTGGGACGCTAGTAACCATGGCTTGCTGACTTAG

MEPPGDWGPPWRSTPKTDVLRLVLYLTFLGAPCYAPALPSCKEDEYPVGSECCPKCSPGYRVKEACGELTGTVCEPCPPGTYIAHLNGLSK
CLQCQMCDPAMGLRASRNCSPGHFCIVQDGDHCAACRAYATSSPGQRVQKGGTESQDTLCQNCPPGTFSPNGTLEECQHQTK
CSWLVTKAGAGTSSSHWV *PNKGSGTTSGTTRLLSGHTCFTLTGLLGTLVTMGLLT*

*FIG. 5DD* hPDL2-GPI

ATGATCTTCCTCCTGCTGCTAATGTTGAGCCTGGAATTGCAGCTTTATTCACAGATATAGCAGCTTTATTCACAGATAGCAGTCCCTAAGGAACTGTACATAA
TAGAGAGCATGGCAGCAGACAATGTGACCCTGGAATGTAACTTTGACACTGGAAGTCATGTGAACTTTGAGAGCAATAACAGCCAGTTTGCAAAAGGTGGA
AAATGATACATCCCCACACCGTGAAAGAGCCACTTTGCTGGAGGAGCAGCCCCTGGGAAGGCCTCGTTCCACATACCTCAAGTCCAAGTG
AGGGACGAAGGACAGTACCAATGCATAATCATCTATGGGGTCGCCGCTGGGACTACAAGTACCTGACTCTGAAAGTCAAAGCTTCCTACAGGAAAA
TAAACACTCACATCCTAAAGGTTCCAGAAACAGATGAGGTTCACCAGCCACTCCAGGACCCTGAAGGCCTCCTACCAGGTCACCAGTGTTCTGCGCCTAAAGCCACCCCTGGCAGA
CGTCAGCCGTTCCTGCCAACACCAGCCACTCCAGGACCCTGAAGGCCTCCTACCAGGTCACCAGTGTTCTGCGCCTAAAGCCACCCCTGGCAGA
AACTTCAGCTGTGTGTTCTGGAATACTCCGTGAGGGAACTTACTTTGGCCAGCATTGACCTTCAAAGTCAGATGGAACCCAGACCCATCCAA
CTCCAAATAAAGGAAGTGGAACCACTTCAGGTACTACCCGTCTTCTATCTGGCACACGTGTTTCACGTTGACAGGTTTGCTTGGGACGCTAGT
AACCATGGGCTTGCTGACTTAG

MIFLLLMLSLELQLHQIAALFTVTVPKELYIIEHGSNVTLECNFDTGSHVNLGAITTASLQKVENDTSPHRERATLLEEQLPLGKASFHIPQVQV
RDEGQYQCIIIYGVAWDYKYLTLKVKASYRKINTHILKVPETDEVELTCQATGYPLAEVSWPNVSVPANTSHSRTPEGLYQVTSVLRLKPPPGR
NFSCVFWNTHVRELTLASIDLQSQMEPRTHPT PNKGSGTTSGTTRLLSGHTCFTLTGLLGTLVTMGLLT

*FIG. 5EE* hTSG6-GPI

ATGATCATCTTAATTTACTTATTTCTCTTGCTATGGAAGACACTCAAGGATGGGGATTCAAGGATGGAATTTTCATAACTCCATATGGC
TTGAACGAGCAGCCGGTGTGTACAAGCTACCACAGAGAAGCACGTCTGGCAAATACAAGCTCACCTACGCAGAAGCTAAGGCGGTGTGTGAATTTGA
AGGCGGCCATCTCGCAACTTGCGAAGCAGCTAGAGGCCAGCCAGAAATTCATGTCTGTGCTGATGGCTAAGGGCAGA
GTTGGATACCCCCATTGTGAAGCCAGGCCCAACTGTGAATTTGGAAAAAACTGGCATTATTGATTATGGAATCCGTCTCAATAGGAGTGAAA
GATGGGATGCCTATTGCTACAAGACCCACACGCAAAGGAGTGTGGTGGCGTCTTTACAGATCCAAAGCAAATTTTTAAATCTCCAGCTTCCC
AAATGAGTACGAAGATAACCAAATCTGCTACTGGCACATTAGACTGTCAAGTATGTCAGCGTATTCACCTGAGTTTTTAGATTTTGACCTT
GAAGATGACCCAGGTTGCTTGGCTGATACAGTTACGATGATGCTACGATGATGCTACGATGATGATCTGTGGAGATG
AGCTTCCAGATGACATCACTCAGTACGACATCATGGAGAATGTCATGACCTTGAAGTTTCTAAGTGATGCTTCAGTGACAGCTGGAGGTTTCCAAATCAA
ATATGTTGCAATGGATCCTGTATCCAAGAGTACTACTACCCGTCTTCTTCTATCTGGGCACACGTGTGTTTCACGTTGACAG
TTTAGCCACTTAATCGATCCAAATAAAGGAAGTGGAACCACTTCAGGTACTACTACCCGTCTTCTTCTATCTGGGCACACGTGTGTTTCACGTTGACAG
*GTTTGCTTGGGACGCTAGTAACCATGGGCTTGCTGACTTAG*

MIILIYLFLLLWEDTQGWGFKDGIFHNSIWLERAAGVYHREARSGKYKLTYAEAKAVCEFEGGHLATYKQLEAARKIGFHVCAAGWMAKGR
VGYPIVKPGPNCGFGKTGIIDYGIRLNRSERWDAYCYNPHAKECGGVFTDPKQIFKSPGFPNEYEDNQICYWHIRLKYGQRIHLSFLDFDL
EDDPGCLADYVEIYDSYDDVHGFVGRYCGDELPDDIISTGNVMTLKFLSDASVTAGGFQIKYVAMDPVSKSSQGKNTSTTSTGNKNFLAGR
FSHLID *PNKGSGTTSGTTRLLSGHTCFLTTGLLGTLVTMGLLT*

FIG. 5FF hHVEM-Fc-GPI

ATGGAGCCTCCTGGAGACTGGGGGCCTCCCTGGAGATCCACCCCAAAACCGACGTCTTGAGGCTGGTGCTGTATCTCACCTTCCTGGGAGCCCCCTGCTACGCC
CCAGCTCTCCGTCCTGCCGCTCTGCAAGGAGGACGAGAGTTACCCCAAGTGACTGGGCTCCCAGCCCTCCACCTCATTGCCCACCTACAATGGCTAAGGAGGCCTGCGGAGCTGACGGGC
ACAGTGTGAACCCTGCCCCTGGAACAGAGACAGCGCCGTGTGTGGTGTGACCAAGAAGTGTCTGCAGTGCCAACATGTGTGACCCAGCTGACCTGCGCCGAGC
CGGAACTGCTCCGGACCTTCCAGGACACGCCGTGTGTGGCTGCCATCGTGCTGCAGGACGGACCCTCTCTGTCAGAACTGCCCCCCGGGACCTTGCCGCGCTTACGCCACCTCC
AGCCCGGGGCAGAGAGTGCAGAAGGTGCAGGTGCACCCAGAGACCCGAGACACGAGAACCACCTCTCTGCTGCACAACGGCCAGAGCTCCCCCCTGGGACCTGCCAGCCACCTGTCAG
CACCAGACCAAGTGCAGCTGCGTCAGTTCTTCCCTCTGGGGGCACCGGCAGCGGGTGCAGGACCAGCCACCAGGCCTCAGTGCTTCATGGGGACCTCTGTGGGACTGCCGGACCGCC
GAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGC
GTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAA
GGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGAC
ATCGCCGTGGAGTGGGAGAGCAATGGGCAGCCGGAGAACAACTACAAGACCACGCCTCCCGTGCTGGACTCCGACGGCTCCTTCTTCCTCTACAGCAAGCTCACCGTG
GACAAGAGCAGGTGGCAGCAGGGGAACGTCTTCTCATGCTCCGTGATGCACGAGGCTCTGCACAACCACTACACGCAGAAGAGCCTCTCCCTGTCTCCGGGTAAATC
GATCCAAATAAAGGAAGTGGAACCACTTCAGGTACCACTGGGACCACTGGGACGTTTCACGTTGGGACGCTAGTAACCATGGGCTTG
CTGACTTAG

MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRAS
RNCSRTENAVCGCSPGHFCIVQDGDHCAACRAYATSSPGQRVQKGGTESQDTLCQNCPPGTFSPNGTLEECQHQTKCSWLVTKAGAGTSSSHWVIDDKTHTCPPCPAP
ELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKI
DPNKGSGTTSGTTRLLSGTTRLLSGHTCFTLTGLLGTLVTMGLLT

*FIG. 5GG* mCTLA4-Fc-GPI

ATGGCCTTGTGTCTTGGACTCCGGAGGTACAAAGCTCAACTGCCTTGCCTTCTAGGACTTGGCCTTCTGTTGTAGCCCTGCCTTCTCACTCTTCTTTCATCCCAGTCTTC
TCTGAAGCCATACAGGTGACCCAACCTCAGTGGTTGTTGGCTAGCAGCCATGGTCGCCAGCTTCCATGTGAATATTCACCATTCACACAACACTGATGAG
GTCCGGGTGACTGTGCTGCGGCAGAAATGACCAATGACTGAGGTCTGTGCCACGACATTCACAGAGAAGAATACAGTGGGCTTCCTAGATTACCCCTTC
TGCAGTGGTACCTTTAATGAAAGCAGAGTGAACCTCACCATCCAAGGACTGTTGACACGGACTGTACCTCTGCAAGGTGAACTCATGTACCCA
CCGCCCATACTTTGTGGGCATGGGCAACGGGACCCAGATTTATTGCATTGATGACCCAAGACCCATGGCCCCAAAAACCCCTGAGGTCACATGCG
CGTGTGGTGGACCCTGAACTCCCTGGGGGACCGTCAGTCTTCCTCTTCCCCCCAAAACCCAAGGACACCCTCATGATCTCCCGGACCCCTGAGGTCACATGCG
TGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGT
ACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAG
CCCCCATCGAGAAAACCATCTCCAAAGCCAAAGGGCAGCCCCGAGAACCACAGGTGTACACCCTGCCCCCATCCCGGGAGGAGATGACCAAGAACCAGGTCA
GCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGC
TGGACTCCGACGGCTCCTTCTTCCTCTACAGCAAGCTCACCGTGGACAAGAGCAGGTGGCAGCAGGGGAACGTCTTCTCATGCTCCGTGATGCATGAGGCTC
TGCACAACCACTACACGCAGAAGAGCCTCTCCCTGTCTCCGGGTAAAATGATCCAAATAAGAAGTGGAACCACTTCAGGTACTACCCGTCTTCTATCTG
GGCACACGTGTTTCACGTTGACAGGTTTGCTTGCTTGGGACGCTAGTAACCATGGGCTTGCTGACTTAG

MACLGLRRYKAQLQLPSRTWPFVALITLLFIPVFSEAIQVTQPSVVLASSHGVASFPCEYSPSHNTDEVRVTVLRQTNDQMTEVCATTFTEKNTVGFLDYPF
CSGTFNESRVNLTIQGLRAVDTGLYLCKVELMYPPPYFVGMGNGTQIYVIDPEPCPDSD*IDDKTHTCPPCPAPELLGGPSVFLFPPKPKDTLMISRTPEVTC
VVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQV
SLTCLVKGFYPSDIAVEWESNGQPENNYKTTPPVLDSDGSFFLYSKLTVDKSRWQQGNVFSCSVMHEALHNHYTQKSLSLSPGK*IDPNKGSGTTSGTTRLLS*
GHTCFLTFLTFGLLGTLVTMGLLT*

*FIG. 5HH* mPDL1-C1C2

ATGAGGATATTTGCTGGCATTATATTCACAGCCTGCTCACTTGCTCTGTCTACGGGCCGTTTACTACTATCACGGCTCCAAAGGACTTGTACGTGGTGGAGTATGGCAGC
AACGTCACGATGGAGTGCAGATTCCCTGTAGAACGGGAGCTGGACCTGCTTGCGTTAGTGGTGTACTGGGAAAAGGAAGATGAGCAAGTGATTCAGTTTGTG
GCAGGAGAGGAGGACCTTAAGCCTCAGCACACAGCAACTTCAGGGGGAGAGCCTCCGCTGCCAAAGGACCAGCTTTTGAAGGGAAGATGCTGCCCTTCAGATCACA
GACGTCAAGCTGCAGGACGCAGGGATTCTGCAGGACGCGTTTACTGCCATAATCAGCTGGTGCGGACTACAGCGGTGTTATCCAGAGGCCTGAAAGTCAATGCTGCCATACCGCAAA
ATCAACCAGAGAATTTCCGTGGATCCAGCATGAACTAATATGTCAGAAGCTGAGTAATCTGGACAACAGTGAC
CACCAACCCGTGAGTGGGAAGAGAAGTGTCACCACTTCCCGGACAGAGGATGCTTCTCAATGTGACCAGTCTGAGGGTCAACGCCACAGCGAATGAT
GTTTTCTACTGTACGTTTTGGAGATCACAAGCTGGGCAAAACCACACAGCGAGCTGATCATCCCAGAACTGCCTGCAACATCCTCCACAGAACAGGACT
ATCGATGTCGAGCCACTGGGCCATGGAGAGATTGCCACCTGTGCGTGTGACCCTCATCTGCGCCTCATCTGTCCTTCTGGGTTTGCACCTTCTCGTTTGCAGCATTGGGTC
CCGGAGCTGGCCTGCCGGCTGAACCGCGCCAGCAGGGTGCCAGCCGCTTGGTGCCAGCCCTTCAAGGTGCCCTTGCATCGAGATAACCCTGAGTTATCATGACGAATTCGAT
TGGGTAACAGGTGTGGTTAATAAACACACGGAGTTTGTGGAACAAAAAACGGGTCGTGTCAACCTGTTTGAGACCCCTGTTGAGCCCTGGAGGCTCAGTAC
TTCATCCATGATGTACCCCACGAGCTGCCACAGCAGATCAGGGCCCTCCAAGAGCCTGCGCTTTGAGCTTCAGCAACCTGGGCTTGCATCTCTTCCCTGCAACCCCTATGCCTCCCAATCCCTGGGACCTGAAGAAT
GTGAGATTGTACCCCTGACAAGCAGATCAGAACGGCCCTGGTTGGGGAGAGCTACGATCAGTGCTAACGATCAGCCTGCCTAGCGCTATGTGCGCATCCTGGCACAACCGCTGGCTGCCCTGCCCCTGCGCCCTGCTGAGCTGCTGGGCTGTTAG
GAGACGCCCATCCCTGGCCTCGCTATGTGCGCATCCTGGCACAACCGCTGGCTGCCCTGCCCCTGCGCCCTGCTGAGCTGCTGGGCTGTTAG

MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQIT
DVKLQDAGVYYCCIISYGGADYKRITLKVNAPYRKINQRISVDPATSEHELICQAEGYPEAEVIWTNSDHQPVSGKRSVTTSRTEGMLLNVTSSLRVNATAND
VFYCTFWRSQPGQNHTAELIIPELPATHPPQNRTIDVEPLGMENGNIANSQIAASSVRVTFLGLQHWVPELARLNRAGMVNAWTPSSNDDNPWIQVNLLRRM
WVTGVTQGASRLASHEYLKAFKVAYSLNGHEFDFTHDVNKKHKEFVGNWNKNAVHVNLFETPVEAQYVRLYPTSCHTACTLRFELLGCELNGCANPIGLKN
NSIPDKQITASSSYKTWGLHLFSWNPSYARLDKQGNFNAWVAGSYGNDQWLQIFPGNWDNHSHKKNLFETPILARYVRILPVAWHNRIALRLELLGC

*FIG. 5II* mPDL1-Fc-GPI

ATGAGGATATTTGCTGGCATTATATTCACAGCCCTGCTCTTGCTCAGGGCCGTTTACTAGTGCTCACGGCTCCAAAGGACTTGTACGTGGTGGAGTATGGCAGC
AACGTCACGATGGAGTGCAGATTCCCTGTAGAACGAGATCTGGCTTGCGTTAGTGGGAGCTGGACCTGCCTTGCCTTAGATGAGCAAGTGATTCAGTTTGTG
GCAGGAGAGGAGGACCTTAAGCCTCAGCACAGCAACTTCAGGGGAGAGCCTCGCTGCCAAAGGACCAGCTTTGAAGGAGAAATGTGCCCTTCAGATCACA
GACGTCAAGCTGCAGGACGCAGGAGTTTACTGCTGCATAATCAGCTACGGTGGTGCGGATTCAGCTGAGCATGAACTAATACAGAGCCGAGGGGTTATCAGCCTCGAGAAGAAGGTAATCTGGACAAACAGTGAC
ATCAACCAGAGAATTTCCGTGGATCCAGCCACTTCTGAGCATGAACTAATACAGAGCCGAGGGGTTATCAGCCTCGAGAAGAAGCTGAGGAGTCAATGATCTGGACAAACAGTGAC
CACCAACCCGTGAGTGGGAAGAGAAGTGTCACCACTCAGGTCTTCTCAAATGAACGCAGTCTGAGGGTCAACGCCACAGCCGAATGAT
GTTTTCTACTGTACGTTTTGGAGATCACAGACCAGGCAATCATCCCAGAGCTGATCATCCCAGAACTGCCTGCAACACATCCTCCACAGAACAGACT
ATCGATGACAAAACTCACACATGCCCACCGTGCCCAGAACTCCTGGGGGGACCGTCAGTCTTCCTCTTCCCCCAAAACCCAAGGACACCCTCATG
ATCTCCCGGACCCCTGAGGTCACATGCGTGGTGGTGGACGTGAGCCACGAAGACCCTGAGGTCAAGTTCAACTGGTACGTGGACGGCGTGGAGGTGCATAAT
GCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAG
TGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCC
CGGGAGGAGATGACCAAGAACCAGGTCAGCCTGACCTGCCTGGTCAAAGGCTTCTATCCCAGCGACATCGCCGTGGAGTGGGAGAGCAGTGGCAGCCGGAG
AACAACTACAAGACCACGCCTCCCGTGCTGGACTCCGACGGCTCCTTCTTCCTCTACAGCAAGCTCACCGTGGACAAGAGCAGGTGGCAGCAGGGGAACGTC
TTCTCATGCTCCGTGATGCATGAGGCTCTGCACAACCACTACACGCAGAAGAGCCTCTCCCTGTCTCCGGGTAAATAACCATGGGCTTGCTGCTGACTTAG
ACTTCAGGTACTACTACCCCGTCTTCTAATCTGGGACGCCGTTCACGTTGTTTCACGTTGTCACGTTCACGTTTGAC

MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQIT
DVKLQDAGVYCCIISYGGADYKRITLKVNAPYRKINQRISVDPATSEHELICQAEGYPEAEVIWTNSDHQPVSGKRSVTTSRTEGMLLNVTSSLRVNATAND
VFYCTFWRSQPGQNHTAELIIPELPATHPPQNRTIDDKTHTCPPCPAPELLGGPSVFLFPPKPKDTLMISRTPEVTCVVVDVSHEDPEVKFNWYVDGVEVHN
AKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGKIDPNKGSGTTSGTTRLLSGHTCFTLTGLLGTLVTMGLLT

*FIG. 5JJ* mPDL1-GPI

ATGAGGATATATTTGCTGGCATTATATATTCACAGCCTGCTGTCACTTGCTCACGGGCCGTTTACTATCACGGCTCCAAAGGACTTGTACGTGGTGGA
GTATGGCAGCAACGTCACGATGGAGTGCAGATTCCCTGTAGAACGGGAGCTGGACCTGCTTGCGTTAGTGGTGGTGTACTGGGAAAAGGAAGATG
AGCAAGTGATTCAGTTTGTGGCAGGAGAGGACCCTTAAGCCTCAGCAGCAGCCTCGCTGCCAAAGGACCAGCTT
TTGAAGGGAAATGCTGCCCTTCAGATCAATGCCCATACCGCAAATCAACAGCTGCATAATCAGCTACGGTGTGCGGACTA
CAAGCCGAATCACGCTGAAAGTCTGAAATCAATGCCCATACCGCAAATCAACAGAGAATTTCCGTGGATCCAGCCACTTCTGAGCATGAACTAATAT
GTCAGGCCGAGGTTATCCAGAAGCTTCAATGTGACCAGCAGTCTGAGGGTCAACGCCACAGTGACCACCAACCGTGAGTGGGAAGAGAAGTGTCACCACTTCCCGG
ACAGAGGGATGCTTCTCAATGTGACCAGCGGAGCTGATCATCCCAGAACTGCCTGCAACACATCCTCCACAGAAGTGTTTCTACTGTACGTTTTGGAGATCACAGCC
AGGGCAAAACCACACTACCCGTCTTCTATCTGGCACACGTGTTTCACGTTGACAGTTTGCTGGACGTAGTAACCATGGGCTTGCTGACTTAG
CTTCAGGTACTACCCGTCTTCTATCTGGCACACGTGTTTCACGTTGACAGTTTGCTGGACGTAGTAACCATGGGCTTGCTGACTTAG

MRIFAGIIFTACCHLLRAFTITAPKDLYVVEYGSNVTMECRFPVERELDLLALVVYWEKEDEQVIQFVAGEEDLKPQHSNFRGRASLPKDQL
LKGNAALQITDVKLQDAGVYCCIISYGGADYKRITLKVNAPYRKINQRISVDPATSEHELICQAEGYPEAEVIWTNSDHQPVSGKRSVTTSR
TEGMLLNVTSSLRVNATANDVFYCTFWRSQPGQNHTAELIIPELPATHPPQNRT *PNKGSGTTSGTTRLLSGHTCFTLTGLLGTLVTMGLLT*

*FIG. 5KK* mPDL2-C1C2

ATGCTGCTCCTGCTGCCGATACTGAACCTGAACTTCATCCTGAGCTTACAACTTCATCCTGTAGCAGCTTTATTCACCGTGACAGCCCCCTAAAGAAGTGTACACCGTAGACGTC
GGCAGCAGTGTGAGCCTGGAGTGCGATTTTGACCGCAGAGAATGCACTGAACTGGAAGGGATAAGACCAGTTTGCAGAAGGTAGAAAATGATACGTCTCTG
CAAAGTGAAAGAGCCACCCTGCTGGAGGAGCAGCTGCCCCTGGGAAAGGCTTTGTTCCACATCCCTAGTGTCCAAGTGACACTGAGATTCCGGCAGTACCGTTGC
CTGGTCATCTGCGGGGCCGCTGGACTTACAAGTGACCAAGATGGAAAGTCAAAGCTTCTTACATGAGGATAGACACTGAGATCCTGGAGGTTCCAGTACA
GGGGAGGTGCAGCTGCCAGGTGACCTAGAGGTTATCCCCTAGCAGAGGTGTCCTGCAAAATGTCAGTGTTCAGTGCATGTTCTGAAATGCTCACATGAAGGAGCTGACTTCA
GAAGGCCCTACCAGTGTTCTGCGCCTCAAGCCTCAGCTGAACGATCGATGTCGAGCATGGGAACATTGCCAACTCACAGATC
GCCATCATTGACCCTGAGTCGGATGAACCCAAAGTCCCCAGAACGATCGATGTCGAGCATGGGAACATTGCCAACTCACAGATC
GCCCTCATCTGCGTGTGACCTTCTGGGTTTGCAGCATTGGGTCCCGGAGCTGGCCCTGAACGTCGCCAGGCATGTCAATGCCTGGACACCCAGC
AGCAATGACGATAACCCCTGGATTCAAGGGCCTTCAAGTGTCAAGTCCCTTAATGGACACAGGAGTTGGGTAACTGAACAAA
CTGAAGGCCGTTCAAGGTGGCCTACACAGCTTCGATTTCATCCATGATGTTAATAAAACACAAGGAGTTTGTGGGTAACTGAACAAA
AACGCGGTGACATGTCAACCTGTTTGAGACCCGTGGAGGCTCAGTACGTCAGTACGTGAGATTGTACCCCACGAGCTGCCACAGCAGATCACGGCCTCCAGCAGTCACATCAGGGT
CTGGGCTGTGAGCTGAACGGATGCGCAACCTTCAGCAGCTTCAAGAATAACAGGCAACTCACATCCCTGAAGAATAACAGGCAACTCACATCCCTGAAGAATAACAGGCAACTCACATCCCTGAAGGAGGCCTGGAACGATCAGTGCTGCAG
TTGCATCTCTTCAGCTGAACGGATGCGCAACCCCCTCCTATGCGAACCCCTCCTATGCCGAACCTCCTATGCCGCGAGCTCCTGCCAACGGCCCCATCCTGGCCTATGTGCCAACACGGCCTAACGATCAGTGCTGCAG
ATCTTCCCTGCCCTGCCGCCTGGAGCTGCCTGGCACAAC
CGCATCGCCCTGCGCCTGGAGCTGCTGGGCTGTTAG

MLLLLPILNLSLQLHPVAALFTVTAPKEVYTDVGSSVSLECDFDRRECTELEGIRASLQKVENDTSLQSERATLLEEQLPLGKALFHIPSVQVRDSGQYRC
LVICGAAWDYKYLTVKVKASYMRIDTRILEVPGTGEVQLTCQARGYPLAEVSWQNVSVPANTSHIRTPEGLYQVTSVLRLKPQPSRNFSCMFWNAHMKELTS
AIIDPLSRMEPKVPRT IDVEPLGMENGNIANSQIAASSVRVTFLGLQHWVPELARLNRAGMVNAWTPSSNDDNPWIQVNLLRRMWVTGVVTQGASRLASHEY
LKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWG
LHLFSWNPSYARLDKQGNFNAWVAGSYGNDQWLQIFPGNWDNHSHKKNLFETPILARYVRILFVAWHNRIALRLELLGC

*FIG. 5LL* mPDL2-Fc-GPI

```
ATGCTGCTCCTGCCTGCCGATACTGAACCTGAGCTTACAACTTCATCCTGTAGCAGCTTTATTCACCGTGACAGCCCCTAAAGAAGTGTACACCGTAGACGTCGGCAG
CAGTGTGAGCCCTGGAGTGCGATTTTGACCGCAGTTTGCACTGAACTGAAGAGCCACTGAATAAGAGCCAGTTTGCAGAGAATAAGACGTCTCGCAAAGTGAAA
GAGCCACCCTGCTGAGGAGCAGCTGCCCCCTGGGAAAGGCTTTGTTCCACATCCCTAGTGTCAAGTGACATGAGAGATTCCGGGCAGTACCGTTGCCTGGTCATCTGCGGG
GCCGCCTGGGACTACAAGTACCTGACGGTCAAGTGACTACCTGAAAGCTTCAAAGCTTCTTACATGAGGATAGAGACACTAGGATCCTGGAGTTCCAGGTACAGGGGAGGTGCAGCTTACCTG
CCAGGCTAGAGAGGTTATCCCCTCAGCCTTGGAACCTGCCTTGGCAAAATGTCAGTCAGTGAGAATCAGGACCCACATCAGGAGCCCCGAAGGCCTCTACCAGGTCACCAGTG
TTCTGCGCCTCAAGCCTGAAGACTTCAGCTGCATGTTCTGGAATGCTCACATGAAGGAGCTGACTTCAGCCTCTTCCCCCCCAAAACCCCAA
CCCAAAGTCCCCAGAACGATCGATGACGACCCCTGAGGTCACAGTGCCCTGAGGTGTGACGTGAGCCACGAAGACCCTGAGGTCAAGTTCAACTGGTACGTGGACGGCGTGGAGG
TGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTAC
AAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCG
GGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACT
ACAAGACCACGCCTCCCGTGCTGGACTCCGACGGCTCCTTCTTCCTCTACAGCAAGCTCACCGTGGACAAGAGCAGGTGGCAGCAGGGGAACGTCTTCTCATGCTCC
GTGATGCACGAGGCTCTGCACAACCACTACACGCAGAAGAGCCTCTCCCTGTCTCCGGGTAAATCGATCAAATAAAGGAAGTGGAACCACTTCAGGTACTACCCG
TCTTCTATCTGGGACACGTGTTTCACGTTGACACAGGTTTGCTTGGGACGCTAGTAACCATGGGCTTGCTGACTTAG
```

MLLLLPILNLSLQLHPVAALFTVTAPKEVYTVDVGSSVSLECDFDRRECTELEGIRASLQKVENDTSLQSERATLLEEQLPLGKALFHIPSVQVRDSGQYRCLVICG
AAWDYKYLTVKVKASYMRIDTRILEVPGTGEVQLTCQARGYPLAEVSWQNVSVPANTSHIRTPEGLYQVTSVLRLKPQPSRNFSCMFWNAHMKELTSAIIDPLSRME
PKVPRTIDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEY
KCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCS
VMHEALHNHYTQKSLSLSPGKIDPNKGSGTTSGTTRLLSGHTCFTLTGLLGTLVTMGLLT

*FIG. 5MM* mPDL1-mFc-GPI

ATGAGGATATTTGCTGGCATTATATTCACAGCCTGCTCACTTGCTACGGGCGTTACTATCACGGCTCCCAAAGGACTTGTACGTGGTGAGTATGGCAGC
AACGTCACGATGGAGTGCAGATTCCCTGTAGAACACACAGCAACTTAAGCCTCAGCGAGCTGGACCTGCTTGCGTTAGTGGTGTACTGGAAAGATGAGCAAGTGATTCAGTTTGTG
GCAGGAGAGGAGGAGACCTTAAGCCTCAGCAGCACAGCAACTTCAGGGGAGAGCCTGCTTGCGCGAGCCAGCCTGCCAAGCAGCTTTGAAGGGAAATGTGCCCTTCAGATCACA
GACGTCAAGCTGCAGGACGCCAGGCGTTTACTGCTGCATAATCAGCTGAACATAATATGTCAGGCCTGTATCCAGAAGCTGAGGTAATCTGGACAAACAGTGAC
ATCAACCAGAGAATTCCGTGGATCAGCAGCCACTTCACCACTTCCCGGACATGAGAGAAGTGTCACCAGCCAGTCTTCTCAATGTGACCAGCTCTGAGGGTCAACGCCACAGCGAATGAT
CACCAACCCGTGAGTGGGAAGAGAAGTGTCACACAGCCAGGCAAAAACACAGCCAGGCTGATCATCCCAAGCGGAGCTGATCATCCCAAAGGAGTCAACACATCCTCCACAGAACAGGACT
GTTTTCTACTGTACGTTTTGGAGATCATATGTGCATATATGGTACAGTCCCAGAAGTATCACCCAAGCTCCCCAAGCTGTGCTCACCATTACTCTGACTCCTAAGGTC
ACGTGTTGTGGTAGACATCAGCAAGATGATCCGAGGTCCAGTTGCCATCAGCACAGAAGTCCCGAGGTTGTGGAGATGATGGAGACCAAGCGCAACCCGGAG
GAGCAGTTCAACAGCACTTTCCGCTCAGTGAACTTCCATCAGGAACTGGCTCAATGCACAGGAGTTCAATGCAGGTCAACAGTGCAGCT
TTCCCTGCCCCCATCGAGAACCATCTCCAAAACATTCTTCCCTGAAGACATTACTGTCCTCCAAGGAGTGTACCACATTCCACCTCCAAGGAGCAGATACAAGGAACACTCAG
AAAGTCAGTCTGACCTGCATGATGGGCATGATGGCTCTCTACTTCGTGTCATCTGCAGAAGAACAATGTGCAGAAGAGACAACTGGGAGGCAGGAAATACTTTCACCTGTCTGTTACAT
CCCATCATGGACACAGATGGCTCTCTACTTCGTGTCATCTGCAGAAGAACATCTGAAGACAAGTGCTCACCTTCAGTACTACCCGTCTTCTATCT
GAGGGCACACGTGTTTCACGTTGACAGGTTTGCTTGGGACGCTAGTAACCATGGGCTTGCTGACTTAG

MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQIT
DVKLQDAGVYCCIISYGGADYKRITLKVNAPYRKINQRISVDPATSEHELICQAEGYPEAEVIWTNSDHQPVSGKRSVTTSRTEGMLLNVTSSLRVNATAND
VFYCTFWRSQPGQNHTAELIIPELPATHPPQNRT*GCKPCICTVPEVSSVFIFPPKPKDVLTITLTPKVTCVVVDISKDDPEVQFSWFVDDVEVHTAQTQPRE
EQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQ
PIMDTDGSYFVYSKLNVQKSNWEAGNTFTCSVLHEGLHNHHTEKSLSHSPGK PNKGSGTTRLLSGTTRLLSGHTCFTLTGLLGTLVTMGLLT*

*FIG. 5NN* mPDL2-GPI

ATGCTGCTCCTGCTGCCGATACTGAACCTGAGCTTACAACTTCATCCTGTAGCAGCTTTATTCACCGTGACAGCCCCTAAAGAAGTGTACACCGTAGACG
TCGGCAGCAGTGTGAGCCTGTGGAGTGCGATTTGACCGCAGAGATGCACTGAACTGGAAGGATAAGAGCCAGTTTGCAGAAGGTAGAAAATGATACGTC
TCTGCAAAGTGAAAGAGCCACCCTGCTGGAGGAGCAGCTGCCCCCTGGGAAAAGCTTTGTTCCACATCCCTAGTGTCCAAGTGAGAGATTCCGGCAGTAC
CGTTGCCTGGTCATCTGCGGGGCCCTGGGACTACAAGTACCTGACGGTGAAAGTCAAAGCTTCTTACATGAGGATAGACACTAGGATCCTGGAGGTTC
CAGGTACAGGGGAGGTGCAGCTTACCTGCCAGGCTTATCCCCTAGAGGTTATCCGCCTCAAGCCTCACGTGTTCTGCGCCTAGTGTTCTGGAAAATGTCTAG
CAGGACCCCCGAAGGCCTCTACCAGGTCACCAGTGTTCTGCGCCTAGTGTTCTGGATGAACCTCCATGTTCTGGAATGCTCACATGAAG
GAGCTGACTTCAGCACGTTCAGCCATCATTGACCCTCTGAGTCGACAGGTTTGACGTTGCACGTTGACAGGTTTGCTTGGGACGCTAGTAACCATGGGCTTGCTGACTTAG
*TTCTATCTGGGCACACGTGTTTCACGTTGACAGGTTTGCTTGGGACGCTAGTAACCATGGGCTTGCTGACTTAG*

MLLLLPILNLSLQLHPVAALFTVTAPKEVYTVDVGSSVSLECDFDRRECTELEGIRASLQKVENDTSLQSERATLLEEQLPLGKALFHIPSVQVRDSGQY
RCLVICGAAWDYKYLTVKVKASYMRIDTRILEVPGTGEVQLTCQARGYPLAEVSWQNVSVPANTSHIRTPEGLYQVTSVLRLKPQPSRNFSCMFWNAHMK
ELTSAIIDPLSRMEPKVPRT*PNKGSGTTSGTTRLLSGHTCFTLTGLLIGTLVTMGLLT*

FIG. 500 mPDL1-GP/-P2A-mHVEM-GP/

ATGAGGATATTTGCTGGCATTATATATTCACAGCCTGCTGTCACTTGCTACTATCACGGCTCCGTTTACTATTGCTGTCACTGATGTGTCACTTGTGTCACAGCAACGTC
ACGATGGAGTGCAGATTCCCTGTAGAACGGGAGCTGGACCTGCTTGCGTTAGTGGTGTACTGGGAAAAGGAAGATGAGCAAGTGATTCAGTTTGTGGCAGGAGAGGAG
GACCTTAAGCCTCAGCACAGCAACTTCAGGGGAGAGCCTCGGTGGAGAGCCCAGCTTTGAAGGAAATGCTGCCCTTCAGATCACAGACGTCAAGCTGCAGGAC
GCAGGCGTTTACTGCTGTCATAATCAGACTTCAGCTGAGCATACGCGTGGTGCGAGACTACAAGCGAATCACGCTGAAAGTCAATGCCCATACCGCAAAATCAACCAGAGAATTTCCGTGGAT
CCAGCCACTTCTGAGCATCTGAGCAGAGAGGGGATGCTTCTCAATGTGACCAGCAGTCTGAGGGTCAAGCCACAGAACAGATCTGAGAGAGAAGTGTC
ACCACTTCCCGGACAGAGGGGATGCTTCTCAATGTGACCAGCAGTCTGAGGGTCAAGCCACAGAACAGATCTGAGGCTCAAGTGATGTTTTCTACTGTACGTTTTGGAGATCACAGCCAGG
CAAAACCACACAGCGAGCTGATCATCCCAGAACACATCCTGCAACAGGACTCCAAATAAAGGAAGTGGAACTCCACTTCAGTCAGCCTGCTGGTCCTTGTGTC
*CTATCTGGGACGCACAGTGTTTCACGTTGACAGGTTTGCTTGGGACAGCCATGGGCGTTGACGGTAACCATGGGCGTTGACGGTAACCATGGGCGTTGACGGTAACCATGGGCGTCTT*
GGCGACGTGGAGGAGAACCCTGCAGCGCATCTGCTGCAGTATCTCTGCAGCCCTCTCCAGCCCTCATGCAGATGCAGGATGCCACCCTAGTAACCTTCAGGCTGCTGTTACCATGTG
TTCCTTTTGAACTTGCTGCAGTGCTGTGAGAGTCTGCACAGTTCAGTGCAGGATGCCACCCTCCTTGTGGAGACAGAGAGTCCTTGTGCCCCAGTGCCCCATATACCCGCAACCCAGTTACCATGTG
AAGCAGTTCTGCAGTTCTGCAGTGCTGCAGTCCAGTACATACAGGCACAGTATACAGGCACAGTATACCCGCTGAGCAAGTGTCTGCCCTCGGAGTCTGT
GATCCAGAGACATGGGCTTGCTGACCTGGCCAGGAGAGTCTCCAGTGGAGAGTCTCCAGGGACTCTGTGCAGATGCATCCAGGACTGTGCATCGACTGCTACTTCTGTGAGAACCAGGATGGGAGCCACTGT
TCCACATGCTTGCAGCACCAGCACCACCTGCAGGGCACCACCTGCCCCTGCCCCTGCCCCTGGACCAACTGCAGTGCCTGCATTCAACAGTAAGACGTGGGACAACAGCAGTTCTGACTGCATCTGACGACTTCTGA
CTTGGAGGGACTCAGGAGGAATGCCTCAGGTAGTTCCAGGATACCCGTGTCTGACAGGTTGCTTGGGACGTTTGACAGGTTGCTTGGGACGCTAGTAACCATGGGCTTGCTGACT
*AATAAAGGAAGTGGAACCACTTCAGGTACTACCCCGTCTTCTATCTGGGCACACGTGTTTCACGTTGACAGGTTGCTTGGGACGCTAGTAACCATGGGCTTGCTGACT
TAG*

MRIFAGIIFTACCHLLRAFTITAPKDLYVEYGSNVTMECRFPVERELDLLALVVYWEKEDEQVIQFVAGEEDLKPQHSNFRGRASLPKDQLLKGNAALQITDVKLQD
AGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPG
QNHTAELIIPELPATHPPQNRT *PNKGSGTTSGTTRLLSGHTCFTLTGLLGTLVTMGLLTGSGATNFSLLKQAGDVEENPGPMEPLPGWGSAPWSQAPTDNTFRLVPCV*
FLLNLLQRISAQPSCRQEEFLVGDECCPMCNPGYHVKQVCSEHTGTVCAPCPPQTYTAHANGLSKCLPCGVCDPDMGLLITWQECSSWKDTVCRCIPGYFCENQDGSHC
STCLQHTTCPPGQRVEKRGTHDQDTVCADCLIGTFSLGGTQEECLPWTNCSAFQQEVRRGTNSTDTTCSSQ *PNKGSGTTSGTTRLLSGHTCFTLTGLLGTLVTMGLLT*

FIG. 5PP hPDL1-ADAM10

ATGAGGATATTTGCTGTCTTTATATTCATGACCTACTTGCTGAACGCATTACTGTCACTGTTCCCAAGGACCTATATGTGGTAGAGTATGGTAGC
AATATGACAATTGAATGCAAATTCCCAGTAGAAAACAATTGTCACTAATTGTCTATTGGGAAATGGAGGATAAGAACATTATTCAATTTGTG
CATGGAGAGGAAGACCTGAAGGTTCAGCATAGTAGCCGCTGTTGAAGACTACAGAGCCCGGCTCTCCCTGGAAGCTGCACTTCAGATCACA
GATGTGAAATGCAGGATGCAGGGGTGTACCGTGCATGATGGTGGTGCCGACTACAAGCGAATTACTGTGAAAGTCAATGCCCATACAACAA
ATCAACCAAAGAATTTGGTTGTGGATCCACCTCTGAACATGACCCTGAGGGCTGCCCCAAGGCCGAAGTCATCTGGACAAGCAGT
GACCATCAAGTCCTGAGTGGTGGTAAGACCACCACCACCATAGATCCTGAGGAAAACCATACAGCTGAATTGGTCATCCCAGCACATCCTCCAAATGAAAGG
GAGATTTTCTACTGCACTTTAGGAGATTAGAATCCTGAGGAAAACCATACAGCTGAATTGGTCATCCCAGCACATCCTCCAAATGAAAGG
TGTGGAAATGGAATGGTAGAACAAGGTGAAGAGTTGATTGTGACCAGTGTAGTGACCAGTGTTGGCTATAGTCCTTGTTGTACAGCAGCCTCCAAGTGTGAGAGGAAGA
AATGCAAACTGAAACCTGGGAAACCTGCAGTCCAGTGTACAGCAGCTGGCTGCAAGTGCAAAGTCTGAGAAGTGTCGGGATGAT
TCAGACTGTGCAAGGAAGGAATATGTAAAGCAGCTCTCACAGCATCCTGAAACTTCACAGACTGTAATAGGCATACACAAGTG
TGCATTAATGGCAATGTGCAGGTTCTGTGAGAAATATGGCTTAGAGGAGTGTCCAGTGCTGTGCCAAGATGATGAAAGAATTATGCCAT
GTATGCTGATGAAGAAAATGGACCCATCACTCTGTGCCAATCAGGTCACGTTCATGTGTGCCACTGTGAGTGCCACTGGTGAGTGCTAGGCTCAGTGAGCTGATGGCTCTGCCGATCATGCTGATTATAAG
TCCCCTTGCAACGATTTTGAAACATTGCTAATCCAAGTAGTAGCCACTTCCAGGCACTCTAAACCACTTCCAGGCACTCTAAAGAGGAGAGACCTCCACAGCCCATTCAGCAA
ATATGCAGTGTTCATACTGCAGCGGGTCATCAGCGAGAGTTATCAAATGGGACACATGAGAGAGACGCTAA

MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQIT
DVKLQDAGVYRCMISYGGADYKRITVKVNAPYNKINQRILVDPVTSEHELTCQAEGYPKAEVIWTSSDHQVLSGKTTTTNSKREEKLFNVTSTLRINTTTN
EIFYCTFRRLDPEENHTAELVIPELPLAHPPNERCGNGMVEQGEECDCGYSDQCKDECCFDANQPEGRKCKLKPGKQCSPSQPCCTAQCAFKSKSEKCRDD
SDCAREGICNGFTALCPASDPKPNFTDCNRHTQVCINGQCAGSICEKYGLEECTCASSDGKDDKELCHVCCMKKMDPSTCASTGSVQWSRHFSGRTITLQPG
SPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQ
PQRQRPRESYQMGHMRR

*FIG. 5QQ* hPDL1-4Fc-CD9tm2

ATGAGGATATATTTGCTGTCTTTATATTCATGACCTACTGGCATTTGCTGAACGTAATTACTGTCACGGTTCCAAGGACCATTATGTGGTAGAGTATGTAGCAATAT
GACAATTGAATGCAAATTCCCAGTAGAAAACAATTAGACCTGGCTGCTACTGGAAATGGAGGATAAGAACATTATTCAATTGTGCATGGAGAGG
AAGACCTGAAGGTTCAGCATAGTAGCACAGACAGAGGCCCGGCTGTTGAAGGACCAGCTCTCCATGGAATGCTGCACTTCAGATCACAGATGTGAAATTGCAG
GATGCAGGGGGTGACCAGCCTCACCTCCTGATGACATGAACATGAACCTGAACTGTGACATGTCAGGCTGAGGGCTACCCCGACTCAGATGCCGAAGTCAATCTGGACAAGCCAGTCATCTGACAAGCAGCAGTGACCATCAAGCTCCTGAGTCGTAAGA
TGTGGATCCAGTACCCACCACCAATTCCAAGAGAGAGAAGCTTTCAATGTGACCAGCAGAATCAACACAACTAATGAGATTTTCTACTGCACTTTAGGAGATTA
CCACCACCACCAATTCCAAGAGAGAGAAGCTTTCAATGTGACCAGCAGAATCAACACAACTAATGAGATTTTCTACTGCACTTTAGGAGATTA
GATCCTGAGAGAAACCATACAGCTGAATTGGTCATCCCAGAACTACCTCTGGCACACTCTGGCACCTCTGGCAAATGAAAGGAGTCCAAATATGGTCCCCATCATGCCCATCATGCCC
AGCAGCTGAGTTCCTGGGGGACCATCAGTCTCTTCCCCCCAAAACCCAAGGACACTCTCATGATCTCCCGGACCCTGAGGTCACGTGCGTGGTGGTGGACG
TGAGCCAGGAAGACCCGAGGTCCAGTTCAACTGGTACGTGGATGGCGTGGAGGTGCATAATGCCAAGACAAAGCCGCGGGAGGAGCAGTTCAACAGCACGTACCGT
GTGGTCAGCGTCCTCACCGTCCTGCACCAGGACTGGCTGAATGGCAAGGAGTACAAGTGCAAGGTCTCCAACAAAGGCCTCCCGTCCTCCATCGAGAAAACCATCTC
CAAAGCCAAAGGGCAGCCCCGAGAGCCACAGGTGTACACCCTGCCCCCATCCCGGGATGAGCTGACCAAGAACCAGGTCAGCCTGACCTGCCTGGTCAAAGGCTTCT
ACCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTACAGC
AGGCTAACCGTGGACAAGAGCAGGTGGCAGCAGGGGAACGTCTTCTCATGCTCCGTGATGCATGAGGCTCTGCACAACCACTACACGCAGAAGAGCCTCTCCCTGTC
TCCGGGTAAATTCTACAGGAGTCTATATTCGAGCCGGGCCCCTCATGATGCTGGTGGGCGCCGTGGTCCTGGCCGTGTGCAGGAGTCCCAGTGC

MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQ
DAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRL
DPEENHTAELVIPELPLAHPPNERESKYGPPCPSCPAPEFLGGPSVFLFPPKPKDTLMISRTPEVTCVVVDVSQEDPEVQFNWYVDGVEVHNAKTKPREEQFNSTYR
VVSVLTVLHQDWLNGKEYKCKVSNKGLPSSIEKTISKAKGQPREPQVYTLPPSQEEMTKNQVSLTCLVKGFYPSDIAVEWESNGQPEDNYKTTPPVLDSDGSFFLYS
RLTVDKSRWQEGNVFSCSVMHEALHNHYTQKSLSLSPGKFYTGVYILIGAGALMMLVGFLGCCGAVQESQCVIM hPDL1-4Fc-CD9tm2-KRAS

ATGAGGATATATTGCTGTCTTTATATTCATGACCTACTGGCATTTGCTGCTGAACGCCATTTACTGTCACGGTTCCCAAGGACCTATATGTGGTAGAGTATGGTAGCAATAT
GACAATTGAATGCAAATTCCCAGTAGACATAGTAGCTAGTAGAGCCTGGCTGCACTGTCTATTGGGAAATGAGGATAAGAACATTATTGTGCATGAGAGG
AAGACCTGAAGGTTCAGCATGCATACAGACAGAGCCCGGCTGTTGAAGGACCAGCAGCTCTCCTGCAAATGCTGCACTTCAGATCACAGATGTGAAATTGCAG
GATGCAGGGGTGTACCGCTGCATGATCAGCTATGGTGTGCCGACTACAGCTTTTGAAGTCAATGCCCCATACAAATCAACCAAAGAATTTTGGT
TGTGGATCCAGTCACCTCTGAACATGAACATGAGAGGAAGAGCTTTTCAATGTGACCAGCACATCCTGGCACAGAGTCATCTGACAAGTCATCAAGTCCTGAGTGGTAAGA
CCACCACCAACCAATTCCAAGAGGAGAAGCTTTTCAATGTGACCAGCAGAATCAACACAACTAATGAGATTTTCTACTGCACTTTTAGGAGATTA
GATCCTGAGGAGAAAACCATACAGCTGAATTGGTCATCCCAGAACTACCTGCCACATCCTCCAAATGAAAGGAGTCCAAATATGGTCCCCATCATGCCC
AGCACCTGAGTCCTGGGGGACCCCGAGGTCCAGTTCAACTGGTACGTGGATGGCGTGAAGTGCATAATGCCAAGACAAAGCCGGGAGGAGCAGTTCAACAGCACGTACCGT
GTGGTCAGGGTCCTCACCGTCCTGCACCAGGACTGGCTGAATGGCAAGGAGTACAAGTGCAAGGTCTCCAACAAAGCCCTCCCGTCCCCATCGAGAAAACCATCTC
CAAAGCCAAAGGGCAGCCCCGAGAGCCACAGGTGTACACCCTGCCCCCATCCCGGGAGGAGATGACCAAGAACCAGGTCAGCCTGACCTGCCTGGTCAAAGGCTTCT
ACCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTACAGC
AGGCTAACCGTGGACAAGAGCAGGTGGCAGCAGGGGAATGTCTTCTCATGCTCCGTGATGCATGAGGCTCTGCACAACCACTACACACAGAAGAGCCTCTCCCTGTC
TCCGGGTAAATTCTACACAGGAGTGTATATTCTGATCGGAGCCGGCGCCCTTCCTGGGCTTCCTGGGCTGTGTGGGGTGCGCAGTCCCAGTGCA
AAAAGAAGAAGAAGAAGACAAAGTGTGTAATTATGTAA

MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQ
DAGVYRCMISYGGADYKRITVKVNAPYNKINQRILVVDPVTSEHELTCQAEGYPKAEVIWTSSDHQVLSGKTTTTNSKREEKLFNVTSTLRINTTNEIFYCTFRRL
DPEENHTAELVIPELPLAHPPNERESKYGPPCPSCPAPEFLGGPSVFLFPPKPKDTLMISRTPEVTCVVVDVSQEDPEVQFNWYVDGVEVHNAKTKPREEQFNSTYR
VVRVLTVLHQDWLNGKEYKCKVSNKGLPSSIEKTISKAKGQPREPQVYTLPPSQEEMTKNQVSLTCLVKGFYPSDIAVEWESNGQPEDNYKTTPPVLDSDGSFFLYS
RLTVDKSRWQEGNVFSCSVMHEALHNHYTQKSLSLSPGK*FYTGVYILIGAGALMMLVGFLGCCGAVQESQCKKKKKKTKCVIM*

FIG. 5SS hPDL1-Fc-CD9tm2

ATGAGGATATATTGCTGTCTTTATATTCATGACCTACTGGCATTTGCTGAACGCATTACTGTCGAAGGTTCCCAAGGACCTATATGTGGTAGAGTATGGTAGC
AATATGACAAATTGAATGCAAATTGGAAGGAACCTGGCTGCCACTAATTAGACCTGGCTGCACTAATTGTCTCATTAGGAAGGATAAGGAGATTATTCAATTGTG
CATGGGAGGAAGACCTGAAGGTTCAGCATAGTAGAGACAGAGGCGCTGTTGAAGGACCAGCTCTCCCTGGGAAATGCTGCACTTCAGATCACA
GATGTGAAATTGCAGGATGCAGGGGTGTACCGCTGCATGATCAGCTATGGTGGTCCGACTACAAGCGAATTACTGTGAAAGTCAATGCCCATACACAAA
ATCAACCAAAGAATTTGGTTGTGGAATCAGTCACCTCCAGTCACCACCACCAATTCCAAGAGATCAGGTGACATGTGAACCTGAGGGCTACCCCAAGGCCGAAGTCATCTGGACAAGCAGT
GACCATCAAGTCCTGAGTGGTAAGACAACAACCATGAAGAGAAGCTTTTCAATGTGACCAGCAGAATGAACAACAACTAAT
GAGATTTTCTACTGCACTTTTAGGAGGATTAGATCCTGAGGAAAACCATACAGCTGAATTGGTCATCCCAGAATTGCCACATCCTCTGCCAGTCCCCAAATGAAAGG

ATCGATGACAAAACTCACACATGCCCACCGTGCCCAGCACCTGAACTCCTGGGGGGACCGTCAGTCTTCCTCTTCCCCCCAAAACCCAAGGACACCCTCATG
ATCTCCCGGACCCCTGAGGTCACATGCGTGGTGGTGGACGTGAGCCACGAAGACCCTGAGGTCAAGTTCAACTGGTACGTGGACGGCGTGGAGGTGCATAAT
GCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAG
TGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCC
CGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAG
AACAACTACAAGACCACGCCTCCCGTGCTGGACTCCGACGGCTCCTTCTTCCTCTACAGCAAGCTCACCGTGGACAAGAGCAGGTGGCAGCAGGGGAACGTC
TTCTCATGCTCCGTGATGCATGAGGCTCTGCACAACCACTACACGCAGAAGAGCCTCTCCCTGTCTCCGGGTAAAATCGATTTCTACACAGGAGTCTATATT

CTGATCGGAGCCGGGCCCTCATGATGCTGGTGGGCTTCCTGGGCTGTTGCGGGGCTGTGCAGGAGTCCCAGTGCGTAATTATGTAA

MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQIT
DVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTN
EIFYCTFRRLDPEENHTAELVIPELPLAHPPNERIDKTHTCPPCPAPELLGGPSVFLFPPKPKDTLMISRTPEVTCVVVDVSHEDPEVKFNWYVDGVEVHN
AKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGKIDFYTGVYILIGAGALMMLVGFLGCCGAVQESQCVIM

*FIG. 5TT* hPDL1-Fc-CD9tm2-KRAS

ATGAGGATATTTGCTGTCTTTATATTCATGACCTACTTGGCATTTGCTGAACGCGCTACTTACTGTCACGGTTCCCAAGGACCTATATGTGGTAGAGTATGGT
AGCAATATGACAATTGAATGACAGTAGAAAAACAATTGAAACCTGGCTGCACTAATTGTCATTGGGAGGATAAGAACATTATTCAA
TTTGTGCATGGAGAGGAAGACCTGAAGGTTCAGCATAGCTACAGACAGAGGGCCGCTGTTGAAGGACCAGCTCTATTGGGAAATGCTGCACTT
CAGATCACAGATGTGAAATTGCAGGATGCAGGGGTGTACCGTGCCAGTACAGCTGCTGACTACAAGCGAATTACTGTGAAAGTCAATGCC
CCATACAACAAAATCAACCAAAGAATTTGGTTGTGGATGACCCTGTCACCTCTGAACATGAACTGCATGTCAGGCTGACATCTGAAAGCCGAAGTC
ATCTGGACAAGCAGTGACCATCAAGTCCTGAGTGGTAAGACCATACCAATTCCAAGAGAGAGAAGCTTTTTCAATGTGACCAGCACACTGAGA
ATCAACACAACAACTAATGAGATTTTCTACTGCACTTTTAGGAGATTAGATCCTGAGAGAAAACCATACAGCTGAATTGGTCATCCCAGAACTACCTCTG
GCACATCCTCCAAATGAAAGGATCGATGATCTCCCATGAGTCCGTGCCCAGCCTGAGCTCACAAGCTCCTCGGGGGGACCCTCAGTCTTCCTTCCCC
CCAAAACCCAAGGACACCCTCATGATCTCCCGGACCCCTGAGGTCACATGCGTGGTGGTGGACGTGAGCCACGAAGACCCTGAGGTCAAGTTCAACTGG
TACGTGGACGGCGTGGAGGTGCATAATGCCAAGACAAAGCCGCGGGAGGAGCAGTACAACAGCACGTACCGTGTGGTCAGCGTCCTCACCGTCCTGCAC
CAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCC
CGAGAACCACAGGTGTACACCCTGCCCCCATCCCGGGAGGAGATGACCAAGAACCAGGTCAGCCTGACCTGCCTGGTCAAAGGCTTCTATCCCAGCGAC
ATCGCCGTGGAGTGGGAGAGCAATGGGCAGCCGGAGAACAACTACAAGACCACGCCTCCCGTGCTGGACTCCGACGGCTCCTTCTTCCTCTACAGCAAG
CTCACCGTGGACAAGAGCAGGTGGCAGCAGGGGAACGTCTTCTCATGCTCCGTGATGCATGAGGCTCTGCACAACCACTACACGCAGAAGAGCCTCTCC
CTGTCTCCGGGTAAAATCGATTTCTACACAGGAGTCTATATTCTGATCGGCGCCCTCATGATGCTGGTGGGCTTCCTGGGCTGCTGCGGGCT
GTGCAGGAGTCCCAGTGCAAAAAGAAGAAGAAAAAGACAAAGTGTGTAATTATGTAA

FIG. 5UU

MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAAL
QITDVKLQDAGVYRCMISYGGADYKRITVKVNAPYNKINQRILVVDPVTSEHELTCQAEGYPKAEVIWTSSDHQVLSGKTTTNSKREEKLFNVTSTLR
INTTTNEIFYCTFRRLDPEENHTAELVIPELPLAHPPNERIDDKTHTCPPCPAPELLGGPSVFLFPPKPKDTLMISRTPEVTCVVVDVSHEDPEVKFNW
YVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSD
IAVEWESNGQPENNYKTTPPVLDSDGSFFLYSKLTVDKSRWQQGNVFSCSVMHEALHNHYTQKSLSLSPGKIDFYTGVYILIGAGALMMLVGFLGCCGA
VQESQCKKKKKTKCVIM mPDL1-mFc-CD9tm2

ATGAGGATATATTGCTGCATTATATTCACAGCCTCTGCTGTCACTTGCTACGGGCGTTTACTATATCACGGCTCCAAAGGACTTGTACGTGGTGGAGTATGGCAG
CAACGTCACGATGGAGTGAGGAGACCTTAGAACGGCAGATTCCCTGTAGAACGCAACTTCAGGGGAGCTGCCTTGCGTTAGTGGTGTACTGGGCTTGAAGATGAAGAATGAGCAAGTGATTCAGTTTG
TGGCAGGAGAGGAGGACCTTAAGCCTCAGCAGCAACTTCAGGGGAGAGCCTCGCTGCCAAAGGACCAGCTTTTGAAGGAAATGCTGCCCTTCAGATC
ACAGAGCGTCAAGCTGCAGGAGACGCAGGCGTTTACTGCTGCATAATCAGCTACGGTGCGGACTACAAGCGACTGCGAATCACGCTGAAAGTCAATGCCATACCG
CAAAATCAACCAGAGAATTCCGTGGATCGGAACCACTTCTGAGCATGAACTCTGCAGGCCGAGGTTATCCAGAAGCTGAGGTAATCTGACAAACA
GTGACCACCAACCCGTGAGTGGGAAGAGAAGTGTCACCACTTCCCGGACAGAGGGATGCTTCTCAATGTGACCAGCAGTCTGAGGTCAACGCCACAGCG
AATGATGTTTTCTACTGTACGTTTTGGAGATCGAAACCACACAGCGAGCTGATCATCCCAGAACCTGCCTGCAACACCATCCTCCACAGAA
CAGGACTGGTTGTCACGTGTGTGTTGTGGTAGAACATCAGCAGGATGATCCCGAGGTCCAGTTCCATCTCTTTCATCTTCCCCCCAAAGCCCAAGGATGGCTCAGGATGTGCTCACCATTACTCTGACTC
CTAAGTCACGTGTGTGTTGTGGTAGAACATCAGCAGGATGATCCCGAGGTCCAGTTCAGCTGGTTTGTAGATGATGTGGAGGTGCACAGCAGCTCAGACGCAA
CCCCGGGAGGAGAGCAGTTCAACAGCACTTTCCGCTCAGTGAGCCTGAACTTCCCATCATGCACCAGGAGTTCAAATGCAGGGTCAA
CAGTGCAGCTTTCCCTGCCCCCATCGAGAAACCATCTCAAAACCAAGGCTCAAGTGTACCACCATTCCACCTCCCAAGGAGCAGA
TGGCCAAGGATAAAGTCAGTCTGACCTGCATGATCACAGATTTCTTCCCTGAAGACATTACTGTGGAGTGGCAGTGGAATGGGAGGCAGGAAATACTTTCACCTG
AAGAACACTCAGCGCCTCATGATGAGGGCCTGCACAACCACCACAGAGCCTCCACTCTCCTGTTACCAGGAGTCTATATTCTGATCGGAGCCG
CTCTGTGTTACATGAGGCCTGGTGGGCTTTGGGTGTGTTTCTTGGGCTGCTGCCCGGCTGTGGCGAGGTCCCAGTGCCTAATTATGTAA
GCGCCCTCATGATGCTGGTGGGCTTTGGGTGTGTTTCTTGGGCTGCTGCCGGGCTGTGGCGAGGTCCCAGTGCCTAATTATGTAA

MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQI
TDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATA
NDVFYCTFWRSQPGQNHTAELIIPELPATHPPQNRTGCKPCICTVPEVSSVFIFPPKPKDVLTITLTPKVTCVVVDISKDDPEVQFSWFVDDVEVHTAQTQ
PREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENY
KNTQPIMDTDGSYFVYSKLNVQKSNWEAGNTFTCSVLHEGLHNHHTEKSLSHSPGKFYTGVYLIGAGALMMLVGFLGCCGAVQESQCVIM

*FIG. 5VV* mPDL1-mFc-CD9tm2-KRAS

ATGAGGATATTTGCTGGCATTATATTCACAGCCTGCTGTCACTTGCTGCTACGGGCGTTTACTATCACGGCTCCAAAGGACTTCCAAGTCTGGTGTGGAGTATGGCAGC
AACGTCACGATGGAGTGCAGATTCCCTGTAGAACGGCAACTTAAGCCTCAGCACAGCAACTTCAGGGGAGCTGGAACCTGCCTTAGTGGTGTACGTTGATTCAGTTTGTG
GCAGGAGAGGAGACCTTAAGCCTCAGCACAGCAACTTCAGGGGAGCTGCCTTCGCTGCTGCCAGAGAGCCTGAGGGAAATGCTGCCCTTCAGATCACA
GACGTCAAGCTGCAGGACGCAGGCGTTTACTGCTGCATAATCAGCTACGGTGGAGCTAATATGTCAGGCCGAGTGTATCGAGAAGTCTGAGGTAATCTGGACAAACAGTGAC
ATCAACCAGCCCGTGAGTGGGAAGAGAAGTGTCACCAGCGAGCATCTCCAGCACTTCCCGGACACAGAGGGATGCTTCTCAATGTGACCAGCAGTCTGAGGTCAACGCCAGCGAATGAT
CACCAACCCGTGAGTGGGAAGAGAAGTGTCACCAGCGAGCATCTCCAGCACTTCCCGGACACAGAGGGATGCTTCTCAATGTGACCAGCAGTCTGAGGTCAACGCCAGCGAATGAT
GTTTTCTACTGTACGTTTTGGAGATCACAGCCAGGGCAAAACCACACAGCGAGCTGATCATCCCAGAACTGCCTGCAAACATCCTCCACAGAACAGGACT

*GGTGTAAGCCTTGCATATGTACAGTCCCAGAAGTATCATCTGTCTTCATCTTCCCCCAAGCCCAAGGATGTGCTCACCATTACTCTGACTCCTAAGGTC*
*ACGTGTGTTGTGGTAGACATCAGCAAGGATGATCCGGAGGTCCAGTTCAGCTGGTTTGTAGATGTGGAGGTGCACACAGCTCAAACGCAACCCCGGGAG*
*GAGCAGTTCAACAGCACTTTCCGCTCAGTGAGTGAACTCCATCAGCACTGGCTCACTCCCACCAGTGTCAAATGCAGGGTCAACAGTGCAGCT*
*TTCCCTGCCCCCATCGAGAAAACCATCTCCAAAACCAAAGGCAGACCGAAGGCTCCACAGGTGTACACCATTCCACCTCCCCAGCGAGGAGCAGATGGCCAAGGAT*
*AAAGTCAGTCTGACCTGCATGATAACAGACTTCTTCCCAGAAGACATTACTGTGGAGTGGCAGTGGAATGGGCAGCCAGCGGAGAATACTTCACCTGCTCCTGTTACAT*

*CCCATCATGGACACAGACGGCTCTTACTTCGTCTACAGCAAGCTCAATGTGCAGAAGAGCAACTGGGAGGCAGGAAATACTTTCACCTGCTCCGTGCTGCATGAGGGCCTG*
*GAGGGGCTGCACAACCACCATACTGAGAAGAGCCTCTCTCTGTCTCATAGCCCTGGTAAATTCTACACAGGAGTCTATATTCTGATCGGAGCCGGCGCCCTCATGATG*
*CTGGTGGGCTTCCTGGGCTGCTGCGGGGCTGTGCCAGGAGTCCCAGTGCAGGAGTCGCAGTGCAAAAAAGAAGACAAAAGTGTGTAATTATGTAA*

---

MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQIT
DVKLQDAGVYCCIISYGGADYKRITLKVNAPYRKINQRISVDPATSEHELICQAEGYPEAEVIWTNSDHQPVSGKRSVTTSRTEGMLLNVTSSLRVNATAND
VFYCTFWRSQPGQNHTAELIIPELPATHPPQNRTGCKPCICTVPEVSSVFIFPPKPKDVLTITLTPKVTCVVVDISKDDPEVQFSWFVDDVEVHTAQTQPRE
EQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQ
*PIMDTDGSYFVYSKLNVQKSNWEAGNTFTCSVLHEGLHNHHTEKSLSHSPGKFYTGVYILIGAGALMMLVGFLGCCGAVPESQCKKKKKKTKCVIM*

FIG. 5WW

EAU Dosing Test Articles

|  | Unmodified Exosomes (IVT) | mPD-L1-Fc-GPI Exosomes 1X (IVT) | mPD-L1-Fc-GPI Exosomes 10X (IVT) | mPD-L1 Exosomes (IV) |
|---|---|---|---|---|
| Dose | 2 µl | 2 µl | 2 µl | 5ml/kg |
| Total protein concentration | 40 µg/ml | 40 µg/ml | 400 µg/ml | 40 µg/ml |
| Total protein administered | 80 ng/eye | 80 ng/eye | 800 ng/eye | 50 µg/animal (~200 µg/kg) |
| Exosome concentration | $5.7 \times 10^{10}$/ml | $2.34 \times 10^{10}$/ml | $2.34 \times 10^{11}$/ml | $2.34 \times 10^{10}$/ml |
| Total exosomes administered | $4.7 \times 10^{7}$ | $4.7 \times 10^{7}$ | $4.7 \times 10^{8}$ | $2.93 \times 10^{10}$ |

EAU Dosing Schedule

Intravitreal (IVT) test: IRBP (Day 0), IVT (Day 6), IVT (Day 12), IVT (Day 16), Day 20

Intravitreal (IVT) tolerability: No IRBP (Day 0), IVT (Day 6), IVT (Day 12), IVT (Day 16), Day 20

Intravenous (IV): IRBP (Day 0), IV (Day 1), IV (Day 6), IV (Day 12), IV (Day 16), Day 20

*FIG. 13A*

Engineered Exosome Multivalent Display

Type II Membrane Protein Constructs

Multiple Protein Display

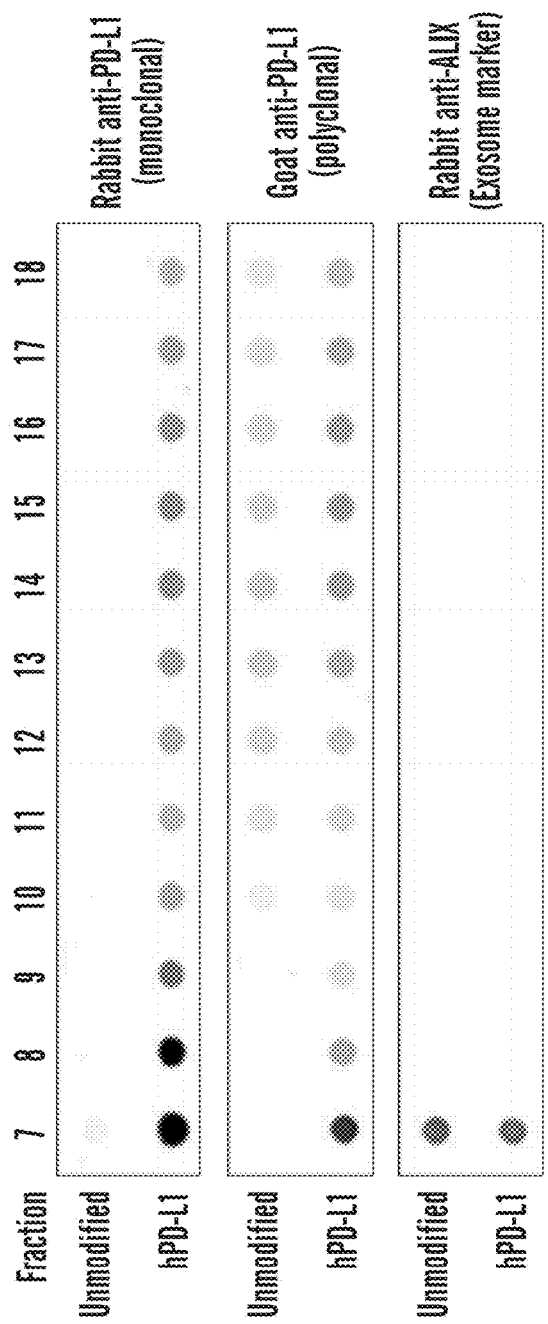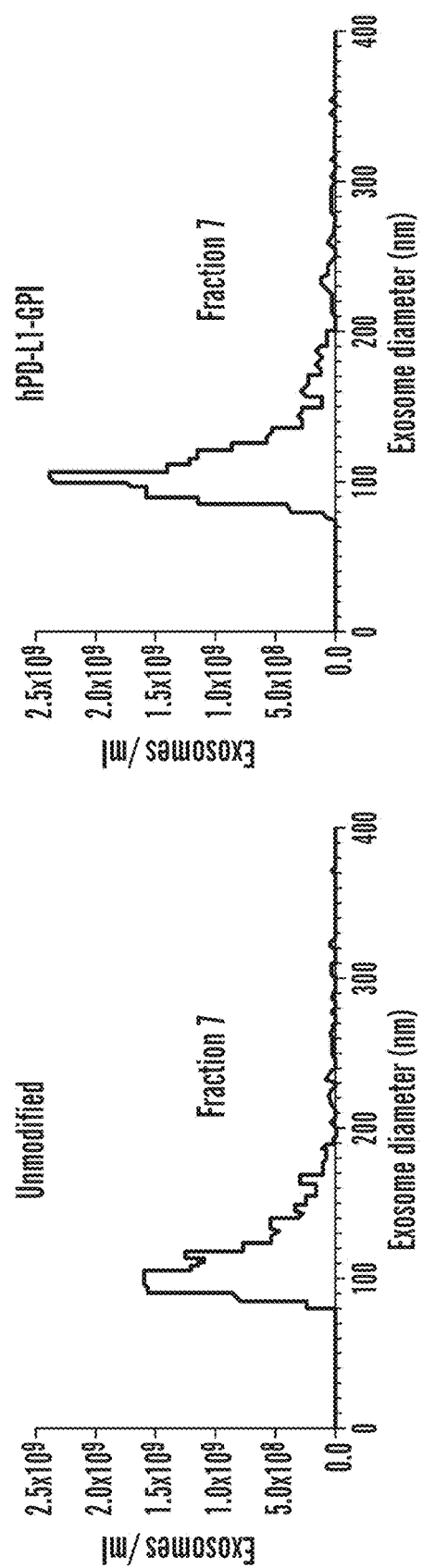
FIG. 24 (cont.)

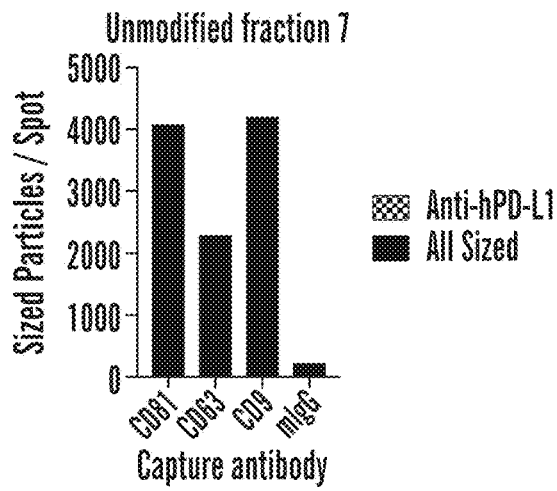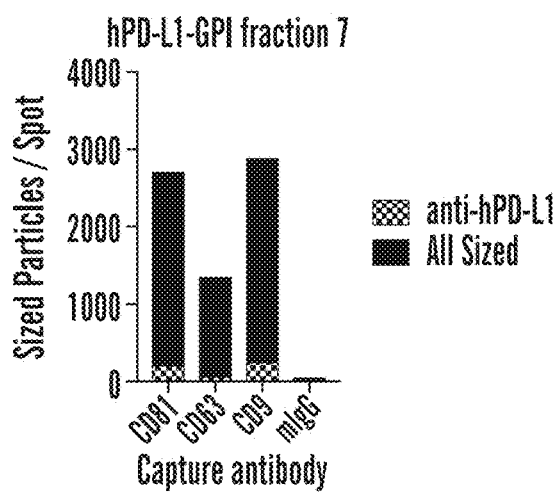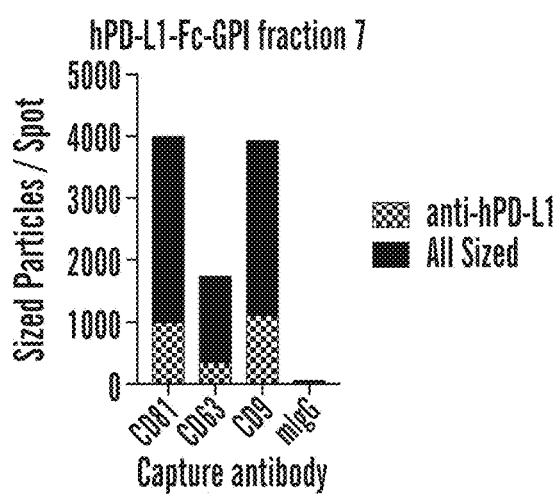
FIG. 28A

Purification of mPDL1-Fc-GPI

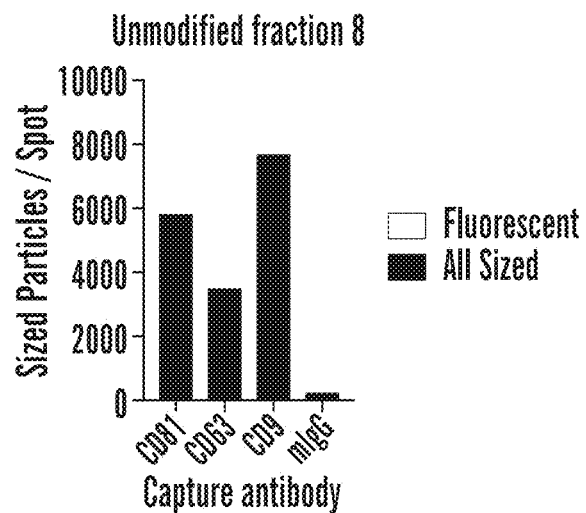
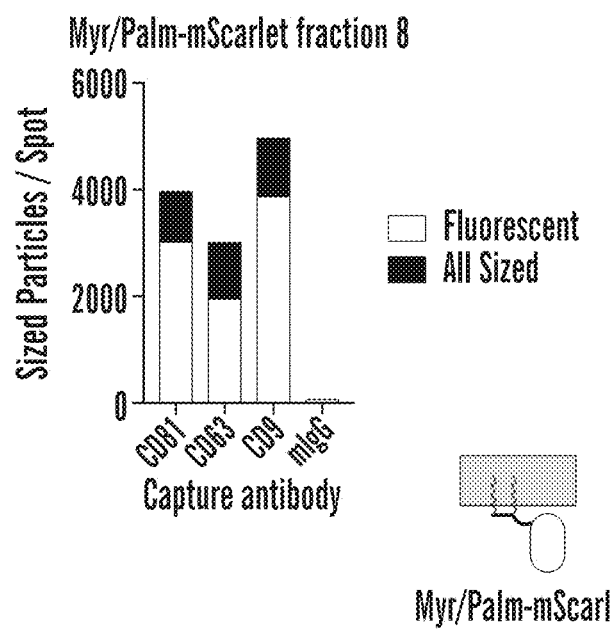
*FIG. 38*

FIG. 39A

EXTRACELLULAR VESICLES COMPRISING ENGINEERED FUSION PROTEINS

CROSS-REFERENCE TO RELATED APPLICATIONS

This application is a continuation of International Application No. PCT/US2021/016949, filed Feb. 5, 2021, which designated the U.S., and also claims the benefit of priority under 35 U.S.C. § 119(e) of U.S. Provisional Application No. 62/970,374, filed Feb. 5, 2020, the contents of both of which are incorporated herein by reference in their entirety.

REFERENCE TO SEQUENCE LISTING

The Sequence Listings submitted on Jul. 16, 2022 and Feb. 28, 2022, and the Sequence Listing submitted May 20, 2022 as a text file named "RevSequenceListing085172-000001US20_ST25" created on May 20, 2022 and having a size of 971,251 bytes, are hereby incorporated by reference.

FIELD OF THE INVENTION

This invention relates to the generation of artificial synapses or extracellular vesicles, including features of extracellular vesicles engineered to deliver signaling, for therapeutic use, including treatment of immune diseases and cancer.

BACKGROUND

Extracellular vesicles (EVs) play a critical role in intercellular communication by transferring microRNAs, lipids, and proteins to neighboring cells. The delivery of encapsulated molecules within EVs is a highly promising strategy as a therapeutic platform in many contexts, exploiting the unique biophysical and biochemical characteristics of extracellular vesicles (EVs). However, there remains a great need in the art for a flexible and dynamic platform, where specific biological signals can be reliably targeted without off-target effects and that provide a robust cellular response to achieve a therapeutic effect, such as modulating inflammation.

SUMMARY

The compositions and methods provided herein are based, in part, on the discovery that extracellular vesicles can be used to express engineered fusion polypeptides that can modulate biological signal generation. These engineered vesicles, also termed artificial synapses, adopt the hallmark biophysical and biochemical features of extracellular vesicles, but are further engineered with vesicle targeting domains (e.g., sticky binders) and signaling domains, optionally joined by a linker with specific functions. The fusion polypeptides provided herein are designed and produced as nucleic acid constructs (e.g., vectors) and expressed in cells, such as mammalian cells. In particular, the vesicle targeting domain of each fusion polypeptide anchors the polypeptide to the extracellular vesicle lipid membrane, thereby presenting the signaling domain(s) of the polypeptide. The signaling domains on or within the vesicle membrane can make contact with recipient cells via target polypeptides (e.g., receptors on the extracellular surface of the recipient cell). Importantly, this strategy can allow for kinetically favorable signal generation and signal propagation. This includes, for example, increasing density of agonist presentation to support receptor clustering of a target receptor located on a target cell—an onerous barrier for traditional receptor targeting strategies.

This strategy was applied to alter immune checkpoint signaling, by engineering artificial synapses through genetic constructs with lipid binding glycosylphosphatidylinositol (GPI) sticky binders joined with programmed death-ligand 1 (PD-L1) signaling domain, e.g., human programmed death-ligand 1 (hPD-L1), expressed in cells and capable of attachment to exosomes. Isolation, purification, and analysis of artificial synapses revealed a high density of signaling domains of the hPD-L1-GPI fusion polypeptide. The hPD-L1 artificial synapse exosomes further demonstrated enhanced agonist signaling than soluble PD-L1 ligand alone, supporting receptor clustering on a target cell. When applied to a model of experimental autoimmune uveoretinitis (EAU), a statistically significant reduction in EAU symptoms was observed.

Thus, in one aspect, provided herein is an engineered extracellular vesicle or artificial vesicle comprising: at least one fusion polypeptide comprising: at least one protein of interest (POI) domain; and at least one vesicle targeting domain. In some embodiments of any of the aspects, the engineered extracellular vesicle is an exosome. In some embodiments, of any of the aspects, the fusion protein further comprises at least one linker. In some embodiments of any of the aspects, the POI domain can substantially bind to a target polypeptide.

In another aspect, provided herein is an engineered extracellular vesicle comprising: at least one fusion polypeptide comprising:
  (i) at least one protein of interest (POI) domain or a fragment thereof; and
  (ii) at least one vesicle targeting domain,
  wherein the POI domain is in an extracellular position relative to a lipid membrane of the extracellular vesicle.

In another aspect, provided herein is an engineered extracellular vesicle comprising:
  (a) a first fusion polypeptide comprising:
    (i) at least one protein of interest (POI) domain or a fragment thereof; and
    (ii) at least one vesicle targeting domain,
  wherein the at least one POI domain is in an extracellular position relative to a lipid membrane of the extracellular vesicle,
  (b) a second fusion polypeptide comprising:
    (i) at least one protein of interest (POI) domain or a fragment thereof; and
    (ii) at least one vesicle targeting domain,
  wherein the POI domain is in an extracellular position relative to a lipid membrane of the extracellular vesicle,
  and wherein the at least one vesicle targeting domain is within a lipid membrane of the extracellular vesicle.

In another aspect, provided herein is an extracellular vesicle composition comprising: a plurality of artificial synapses,
wherein each artificial synapse comprises (i) an extracellular vesicle; (ii) one or more sticky binders; and (iii) one or more signaling domains.

In another aspect, provided herein is a composition comprising a plurality of the engineered extracellular vesicles provided herein.

In another aspect, provided herein is a composition comprising two or more of the engineered extracellular vesicles provided herein.

In another aspect, provided herein is a composition comprising three or more of the engineered extracellular vesicles provided herein.

In another aspect, provided herein is a method of producing the engineered extracellular vesicle or the compositions provided herein, comprising:
(a) providing a population of cells expressing a vector construct encoding one or more sticky binder and one or more signaling domains; and
(b) isolating a plurality of artificial synapses from the population of cells.

In another aspect, provided herein is a method of producing the engineered extracellular vesicle or the compositions provided herein, comprising:
(a) providing a population of cells expressing a vector construct encoding one or more sticky binder and one or more signaling domains; and
(b) isolating a plurality of artificial synapses from the population of cells; and
(c) purifying the plurality of artificial synapses from the population of cells.

In another aspect, provided herein is a method of modulating inflammation in a subject, the method comprising:
administering a composition comprising a plurality of engineered extracellular vesicles to a subject in need thereof, wherein the engineered extracellular vesicles comprise at least one fusion polypeptide comprising:
(i) at least one protein of interest (POI) domain or a fragment thereof; and
(ii) at least one vesicle targeting domain.

In another aspect, provided herein is a use of a composition or engineered extracellular vesicle provided herein for the treatment of an inflammatory disease or condition.

In another aspect, provided herein is a use of a composition or engineered extracellular vesicle provided herein for the treatment of an autoimmune disease or condition.

In another aspect, provided herein is a use of a composition or engineered extracellular vesicle provided herein for the treatment of cancer.

In one embodiment of any of the aspects, the engineered extracellular vesicle is an exosome.

In another embodiment of any of the aspects, the protein of interest (POI) domain or a fragment thereof is a N-terminal domain of the fusion polypeptide. In another embodiment of any of the aspects, the POI domain is selected from the group consisting of: Table 1. In another embodiment of any of the aspects, the POI domain is PD-L1 or a fragment thereof. In another embodiment of any of the aspects, the POI domain is PD-L2 or a fragment thereof. In another embodiment of any of the aspects, the POI domain is FGL1 or a fragment thereof. In another embodiment of any of the aspects, the POI domain is 4-1BBL or a fragment thereof. In another embodiment of any of the aspects, the POI domain is CTLA-4 or a fragment thereof. In another embodiment of any of the aspects, the protein of interest (POI) domain is HVEM or a fragment thereof.

In another embodiment of any of the aspects, the vesicle targeting domain is a C-terminal domain of the fusion polypeptide. In another embodiment of any of the aspects, the vesicle targeting domain is in a luminal position relative to the lipid membrane of the extracellular vesicle. In another embodiment of any of the aspects, the vesicle targeting domain in an exterior position relative to the lipid membrane of the extracellular vesicle. In another embodiment of any of the aspects, the vesicle targeting domain is selected from the group consisting of: Table 3. In another embodiment of any of the aspects, the vesicle targeting domain is selected from the group consisting of: a Glycosylphosphatidylinositol (GPI) anchor, a fatty acylation site, and a prenylation site. In another embodiment of any of the aspects, the vesicle targeting domain is C1C2. In another embodiment of any of the aspects, the vesicle targeting domain is a GPI anchor.

In another embodiment of any of the aspects, the fusion polypeptide comprises at least two POI domains and/or at least two exosome targeting domains.

In another embodiment of any of the aspects, the POI domain substantially binds to one or more of a target polypeptide. In another embodiment of any of the aspects, the target polypeptide is selected from the group consisting of: Table 2.

In another embodiment of any of the aspects, the fusion polypeptide further comprises a peptide linker. In another embodiment of any of the aspects, the fusion polypeptide further comprises a fragment crystallizable region (Fc) domain. In another embodiment of any of the aspects, the linker is in an exterior position relative to the lipid membrane of the extracellular vesicle. In another embodiment of any of the aspects, the linker is a transmembrane linker. In another embodiment of any of the aspects, the linker is in a luminal position relative to the lipid membrane of the extracellular vesicle.

In another embodiment of any of the aspects, the engineered extracellular vesicle does not comprise an endogenous POI polypeptide.

In another embodiment of any of the aspects, the composition further comprises a pharmaceutically acceptable carrier.

In another embodiment of any of the aspects, the one or more sticky binders or the vesicle targeting domain is selected from the group consisting of: a GPI anchor, a fatty acylation site, and a prenylation site.

In another embodiment of any of the aspects, the signaling domain or the protein of interest comprises one or more of: PD-L1, PD-L2, CTLA-4 (CD152), 4-1BBL (CD137L), HVEM (CD270), FGL1, OX-2 (CD200), Galectin-9, PVR (CD155), Nectin-2 (CD112) isoform alpha, Nectin-2 (CD112) isoform beta, Nectin-2 (CD112) isoform delta, IL-10, TSG-6, B7-H3 (CD276), B7-H4 (VTCN1), B7-H5 (VISTA), B7-H7 (HHLA2), BTNL1, VSIG8, VSIG3 (IGSF11), VSIG4, TIM-3 (HAVCR2), TIM-4 (TIMD4), CEACAM1, BTN3A1, BTN3A2, BTN2A1, BTNL8, BTN2A2, BTN1A1, TIGIT, CD27L (CD70), CD30L (CD153), GITRL, CD40L (CD154), LIGHT (CD258), TL1, CD80, CD86, LFA-3 (CD58), SLAM (CD150), CD40, CD28, CD28H, CD2, LFA-3 (CD58), CD48, CD226, DR3, DcR3, FasL, TIM-1 (CD365), PD-1, or active fragment thereof.

In another embodiment of any of the aspects, the isolating is via size exclusion chromatography. In another embodiment of any of the aspects, the purifying is via multimodal chromatography. In another embodiment of any of the aspects, the method further comprises performing an assay for POI binding to a target polypeptide.

In another embodiment of any of the aspects, the vector construct further encodes a promoter. In another embodiment of any of the aspects, the promoter is a tissue-specific promoter or an inducible promotor.

In one embodiment of any of the aspects, the method further comprises selecting a subject that has or is suspected of having an autoimmune disease or an inflammatory disease or condition. In another embodiment of any of the aspects, the inflammatory disease and/or condition is acute. In another embodiment of any of the aspects, the inflammatory related disease and/or condition is chronic.

In another embodiment of any of the aspects, administering the composition provided herein comprises injection, topical administration, or inhalation.

A BRIEF DESCRIPTION OF THE DRAWINGS

FIG. 1 shows construct representation of fusion polypeptides for labeling an exosome surface with Type I membrane proteins.

FIGS. 2A-2B. FIG. 2A shows nucleic acid (SEQ ID NO: 199) and translated protein (SEQ ID NO: 200) sequences of full-length Phosphatidylserine binding: Lactadherin (MFGE8) C1C2. Underlined nucleic acid sequence highlights the sequence translated to the C1C2 protein. Bold and underlined text highlights the C1C2 domain used to anchor signaling domains of interest (i.e. PD-L1 extracellular domain) onto the surface of the Inventors' artificial synapses. FIG. 2B shows nucleic acid (SEQ ID NO: 196) and translated protein (SEQ ID NO: 197) sequences of full length CD55 (DAF) Glycosylphosphatidylinositol (GPI) anchor. Bold and underlined text highlights the GPI anchor domain used to anchor signaling domains of interest (i.e. PD-L1 extracellular domain) onto the surface of the Inventors' artificial synapses engineered from exosomes.

FIG. 3 demonstrates the nucleic acid (SEQ ID NO: 219) and translated protein (SEQ ID NO: 220) sequence for the Fc linker used in genetically engineered constructs is shown in bold and underlined.

FIGS. 4A-4C. FIG. 4A demonstrates nucleic acid (SEQ ID NO: 1) and translated protein (SEQ ID NO: 2) sequence of human PD-L1 (CD274). Bold and underlined sequence highlights the PD-L1 extracellular domain used in the Inventors' artificial synapses engineered from exosomes. FIG. 4B demonstrates nucleic acid (SEQ ID NO: 5) and protein (SEQ ID NO: 6) sequence of human PD-L2. Bold and underlined sequence highlights the PD-L2 extracellular domain used in the Inventors' artificial synapses engineered from exosomes. FIG. 4C shows nucleic acid (SEQ ID NO: 9) and protein (SEQ ID NO: 10) sequence of human CTLA-4 (CD152). Bold and underlined sequence highlights the CTLA-4 extracellular domain used in the Inventors' artificial synapses.

FIGS. 5A-5WW. FIG. 5A shows an exemplary embodiment of pcDNA5-FRT cloning vector with a gene sequence coding for a fusion polypeptide inserted into a multiple cloning site. FIG. 5B shows an exemplary embodiment of the Gateway® destination vector pEF5-FRT-V5-DEST with a gene sequence coding for a fusion polypeptide inserted into a multiple cloning site. The vectors were used for constitutive high-level expression of fusion polypeptide described herein in mammalian cells. FIG. 5C shows the nucleic acid (SEQ ID NO: 223) and protein (SEQ ID NO: 224) sequence for the hCTLA4-Fc-GPI fusion polypeptide wherein the text for the signaling domain is bolded, Fc linker is underlined, and sticky binder is italicized. FIG. 5D shows the nucleic acid (SEQ ID NO: 283) and protein (SEQ ID NO: 284) sequence for the hPDL1-GPI-P2A-hHVEM-GPI fusion polypeptide wherein the text for the signaling domain hPDL1 and hHVEM are bolded, P2A sequence is underlined, and sticky binder GPI is italicized. With P2A included, a self-cleaving peptide sequence, artificial synapses with this feature will have both hPDL1-GPI and hHVEM-GPI loaded onto the surface. FIG. 5E shows the nucleic acid (SEQ ID NO: 239) and protein (SEQ ID NO: 240) sequence for the hPDL1-GPI-P2A-hFGL1-GPI fusion polypeptide wherein the text for the signaling domain hPDL1 and hFGL1 are bolded, P2A sequence is underlined, and sticky binder GPI is italicized. With P2A included, a self-cleaving peptide sequence, artificial synapses with this feature will have both hPDL1-GPI and FGL1-GPI loaded onto the surface. FIG. 5F shows the nucleic acid (SEQ ID NO: 225) and protein (SEQ ID NO: 226) sequence for the hPDL1-GPI fusion polypeptide wherein the text for the signaling domain hPDL1 is bolded and sticky binder GPI is italicized. FIG. 5G shows the nucleic acid (SEQ ID NO: 229) and protein (SEQ ID NO: 230) sequence for the hPDL1-Fc-GPI fusion polypeptide wherein the text for the signaling domain hPDL1 is bolded, Fc is underlined, and sticky binder GPI is italicized. FIG. 5H shows the nucleic acid (SEQ ID NO: 233) and protein (SEQ ID NO: 234) sequence for the hPDL2-Fc-GPI fusion polypeptide wherein the text for the signaling domain hPDL2 is bolded, Fc is underlined, and sticky binder GPI is italicized. FIG. 5I shows the nucleic acid (SEQ ID NO: 227) and protein (SEQ ID NO: 228) sequence for the hPDL1-C1C2 fusion polypeptide wherein the text for the signaling domain hPDL1 is bolded and sticky binder C1C2 is italicized. FIG. 5J shows the nucleic acid (SEQ ID NO: 231) and protein (SEQ ID NO: 232) sequence for the hPDL2-C1C2 fusion polypeptide wherein the text for the signaling domain hPDL2 is bolded and sticky binder C1C2 is italicized. FIG. 5K shows the nucleic acid (SEQ ID NO: 235) and protein (SEQ ID NO: 236) sequence for the 4F2-h41BBL fusion polypeptide wherein the text for the signaling domain h41BBL is bolded and sticky binder 4F2 is italicized. FIG. 5L shows the nucleic acid (SEQ ID NO: 237) and protein (SEQ ID NO: 238) sequence for the hPDL1-4Fc-GPI fusion polypeptide wherein the text for the signaling domain hPDL1 is bolded, 4Fc is underlined, and sticky binder GPI is italicized. FIG. 5M shows the nucleic acid (SEQ ID NO: 243) and protein (SEQ ID NO: 244) sequence for the Myr-NanoLuc Luciferase fusion polypeptide wherein the text for the signaling domain NanoLuc Luciferase is bolded, and sticky binder Myr is italicized. FIG. 5N shows the nucleic acid (SEQ ID NO: 241) and protein (SEQ ID NO: 242) sequence for the Myr-mScarlet fusion polypeptide wherein the text for the signaling domain mScarlet is bolded, and sticky binder Myr is italicized. FIG. 5O shows the nucleic acid (SEQ ID NO: 245) and protein (SEQ ID NO: 246) sequence for the secreted isoform of hPDL1 (SecPDL1) fusion polypeptide hSecPDL1-GPI wherein the text for the signaling domain hSecPDL1 is bolded and sticky binder GPI is italicized. FIG. 5P shows the nucleic acid (SEQ ID NO: 247) and protein (SEQ ID NO: 248) sequence for the Tfr2-h41BBL fusion polypeptide wherein the text for the signaling domain h41BBL is bolded and sticky binder Tfr2 is italicized. FIG. 5Q shows the nucleic acid (SEQ ID NO: 249) and protein (SEQ ID NO: 250) sequence for the CD9tm3-h41BBL fusion polypeptide wherein the text for the signaling domain h41BBL is bolded and sticky binder CD9tm3 is italicized. FIG. 5R shows the nucleic acid (SEQ ID NO: 251) and protein (SEQ ID NO: 252) sequence for the Myr/Palm-4F2-h41BBL fusion polypeptide wherein the text for the signaling domain h41BBL is bolded, sticky binder Myr/Palm is underlined, and sticky binder 4F2 is italicized. FIG. 5S shows the nucleic acid (SEQ ID NO: 253) and protein (SEQ ID NO: 254) sequence for the Myr/Palm-Link-h41BBL fusion polypeptide wherein the text for the signaling domain h41BBL is bolded, sticky binder Myr/Palm is italicized and underlined, and sticky binder Link (in this embodiment a GSSG linker) is in regular text (not underlined and not italicized). FIG. 5T shows the nucleic acid (SEQ ID NO: 255) and protein (SEQ ID NO: 256) sequence for the hPDL1-Link-GPI fusion polypeptide wherein the text for the signaling domain hPDL1 is bolded, Link is underlined (in this embodiment a GSSG linker), and sticky binder GPI is italicized. FIG. 5U shows the nucleic acid (SEQ ID NO: 257) and protein (SEQ ID NO: 258) sequence for the secreted isoform of hPDL1 (SecPDL1) fusion polypeptide hSecPDL1-CD9tm2 wherein the text for the signaling domain hSecPDL1 is bolded and sticky binder CD9tm2 is italicized. FIG. 5V shows the nucleic acid (SEQ ID NO: 259) and protein (SEQ ID NO: 260) sequence for the secreted isoform of hPDL1 (SecPDL1) fusion polypeptide hSecPDL1-CD9tm2-KRAS wherein the text for the signaling domain hSecPDL1 is bolded, sticky binder CD9tm2 is italicized, and sticky binder KRAS is italicized and underlined. FIG. 5W shows the nucleic acid (SEQ ID NO: 261) and protein (SEQ ID NO: 262) sequence for the secreted isoform of hPDL1 (SecPDL1) fusion polypeptide hSecPDL1-CD9tm4 wherein the text for the signaling domain hSecPDL1 is bolded and sticky binder CD9tm4 is italicized. FIG. 5X shows the nucleic acid (SEQ ID NO: 263) and protein (SEQ ID NO: 264) sequence for the secreted isoform of hPDL1 (SecPDL1) fusion polypeptide hSecPDL1-CD81 wherein the text for the signaling domain hSecPDL1 is bolded and sticky binder CD81 is italicized. FIG. 5Y shows the nucleic acid (SEQ ID NO: 265) and protein (SEQ ID NO: 266) sequence for the hCD200-Fc-GPI fusion polypeptide wherein the text for the signaling domain hCD200 is bolded, Fc is underlined, and sticky binder GPI is italicized, a spacer sequence domain (regular text, not underlined and not italicized) separates hCD200 sequence from the Fc domain, a spacer sequence domain (regular text, not underlined and not italicized) separates Fc sequence from the GPI. FIG. 5Z shows the nucleic acid (SEQ ID NO: 267) and protein (SEQ ID NO: 268) sequence for the hFGL1-GPI fusion polypeptide wherein the text for the signaling domain hFGL1 is bolded, and sticky binder GPI is italicized. FIG. 5AA shows the nucleic acid (SEQ ID NO: 269) and protein (SEQ ID NO: 270) sequence for the hGal9-Fc-GPI fusion polypeptide wherein the text for the signaling domain hGal9 is bolded, Fc is underlined, and sticky binder GPI is italicized. FIG. 5BB shows the nucleic acid (SEQ ID NO: 271) and protein (SEQ ID NO: 272) sequence for the hCD200-GPI fusion polypeptide wherein the text for the signaling domain hCD200 is bolded, and sticky binder GPI is italicized. FIG. 5CC shows the nucleic acid (SEQ ID NO: 273) and protein (SEQ ID NO: 274) sequence for the hGal9-GPI fusion polypeptide wherein the text for the signaling domain hGal9 is bolded, and sticky binder GPI is italicized. FIG. 5DD shows the nucleic acid (SEQ ID NO: 275) and protein (SEQ ID NO: 276) sequence for the hHVEM-GPI fusion polypeptide wherein the text for the signaling domain hHVEM is bolded, and sticky binder GPI is italicized. FIG. 5EE shows the nucleic acid (SEQ ID NO: 277) and protein (SEQ ID NO: 278) sequence for the hPDL2-GPI fusion polypeptide wherein the text for the signaling domain hPDL2 is bolded, and sticky binder GPI is italicized. FIG. 5FF shows the nucleic acid (SEQ ID NO: 279) and protein (SEQ ID NO: 280) sequence for the hTSG6-GPI fusion polypeptide wherein the text for the signaling domain hTSG6 is bolded, and sticky binder GPI is italicized. FIG. 5GG shows the nucleic acid (SEQ ID NO: 281) and protein (SEQ ID NO: 282) sequence for the hHVEM-Fc-GPI fusion polypeptide wherein the text for the signaling domain hHVEM is bolded, Fc is underlined, and sticky binder GPI is italicized. FIG. 5HH shows the nucleic acid (SEQ ID NO: 285) and protein (SEQ ID NO: 286) sequence for the mCTLA4-Fc-GPI fusion polypeptide wherein the text for the signaling domain mCTLA4 is bolded, Fc is underlined, and sticky binder GPI is italicized. FIG. 5II shows the nucleic acid (SEQ ID NO: 287) and protein (SEQ ID NO: 288) sequence for the mPDL1-C1C2 fusion polypeptide wherein the text for the signaling domain mPDL1 is bolded and sticky binder C1C2 is italicized. FIG. 5JJ shows the nucleic acid (SEQ ID NO: 289) and protein (SEQ ID NO: 290) sequence for the mPDL1-Fc-GPI fusion polypeptide wherein the text for the signaling domain mPDL1 is bolded, Fc is underlined, and sticky binder GPI is italicized. FIG. 5KK shows the nucleic acid (SEQ ID NO: 291) and protein (SEQ ID NO: 292) sequence for the mPDL1-GPI fusion polypeptide wherein the text for the signaling domain mPDL1 is bolded and sticky binder GPI is italicized. FIG. 5LL shows the nucleic acid (SEQ ID NO: 293) and protein (SEQ ID NO: 294) sequence for the mPDL2-C1C2 fusion polypeptide wherein the text for the signaling domain mPDL2 is bolded and sticky binder C1C2 is italicized. FIG. 5MM shows the nucleic acid (SEQ ID NO: 295) and protein (SEQ ID NO: 296) sequence for the mPDL2-Fc-GPI fusion polypeptide wherein the text for the signaling domain mPDL2 is bolded, Fc is underlined, and sticky binder GPI is italicized. FIG. 5NN shows the nucleic acid (SEQ ID NO: 297) and protein (SEQ ID NO: 298) sequence for the mPDL1-mFc-GPI fusion polypeptide wherein the text for the signaling domain mPDL2 is bolded, mFc is underlined, and sticky binder GPI is italicized. FIG. 5OO shows the nucleic acid (SEQ ID NO: 299) and protein (SEQ ID NO: 300) sequence for the mPDL2-GPI fusion polypeptide wherein the text for the signaling domain mPDL2 is bolded and sticky binder GPI is italicized. FIG. 5PP shows the nucleic acid (SEQ ID NO: 301) and protein (SEQ ID NO: 302) sequence for the mPDL1-GPI-P2A-mHVEM-GPI fusion polypeptide wherein the text for the signaling domain mPDL1 and mHVEM are bolded, P2A sequence is underlined, and sticky binder GPI is italicized. With P2A included, a self-cleaving peptide sequence, artificial synapses with this feature will have both mPDL1-GPI and mHVEM-GPI loaded onto the surface. FIG. 5QQ shows the nucleic acid (SEQ ID NO: 303) and protein (SEQ ID NO: 304) sequence for the hPDL1-ADAM10 fusion polypeptide wherein the text for the signaling domain mPDL1 is bolded and sticky binder ADAM10 is italicized. FIG. 5RR shows the nucleic acid (SEQ ID NO: 305) and protein (SEQ ID NO: 306) sequence for the hPDL1-4Fc-CD9tm2 fusion polypeptide wherein the text for the signaling domain hPDL1 is bolded, 4Fc is underlined, and sticky binder CD9tm2 is italicized. FIG. 5SS shows the nucleic acid (SEQ ID NO: 307) and protein (SEQ ID NO: 308) sequence for the fusion polypeptide hPDL1-4Fc-CD9tm2-KRAS wherein the text for the signaling domain hPDL1 is bolded, sticky binder 4Fc is underlined, sticky binder CD9tm2 is italicized, and sticky binder KRAS is italicized and underlined. FIG. 5TT shows the nucleic acid (SEQ ID NO: 309) and protein (SEQ ID NO: 310) sequence for the hPDL1-Fc-CD9tm2 fusion polypeptide wherein the text for the signaling domain hPDL1 is bolded, Fc is underlined, and sticky binder CD9tm2 is italicized. FIG. 5UU shows the nucleic acid (SEQ ID NO: 311) and protein (SEQ ID NO: 312) sequence for the fusion polypeptide hPDL1-Fc-CD9tm2-KRAS wherein the text for the signaling domain hPDL1 is bolded, sticky binder Fc is underlined, sticky binder CD9tm2 is italicized, and sticky binder KRAS is italicized and underlined. FIG. 5VV shows the nucleic acid (SEQ ID NO: 313) and protein (SEQ ID NO: 314) sequence for the mPDL1-mFc-CD9tm2 fusion polypeptide wherein the text for the signaling domain mouse PDL1 (mPDL1) is bolded, mouse mFc (mFc) is underlined, and sticky binder CD9tm2 is italicized. FIG. 5WW shows the nucleic acid (SEQ ID NO: 315) and protein (SEQ ID NO: 316) sequence for the fusion polypeptide mPDL1-mFc-CD9tm2-KRAS wherein the text for the signaling domain mPDL1 is bolded, sticky binder mFc is underlined, sticky binder CD9tm2 is italicized, and sticky binder KRAS is italicized and underlined. Wherein mPDL1 and mFc are mouse PDL1 and mouse Fc, respectively.

FIG. 6 shows hPD-L1-Fc-GPI artificial synapse purification via a multimodal resin marketed for exosome purification. Large MW artificial synapses elute in the first fraction as shown by the high hPD-L1 concentration and artificial synapse quantity (2.26E9 synapses/ml) in elution 1. Clean in place (CIP) fractions show bound and eliminated proteins from the Inventors' artificial synapse elution.

FIG. 7 shows hPDL1-Fc-GPI exosome purification via size exclusion chromatography using a resin marketed for exosome purification. Artificial synapses engineered from exosomes eluted from via a multimodal resin may be further purified via size exclusion chromatography using a resin marketed for exosome purification as shown here. Using a size exclusion chromatography, artificial synapses elute in fractions 7-9. Total protein (determined by qBit) and hPD-L1 ng/ml (determined by ELISA) of each fraction is shown in the graph. Bars show exosome number per ml (i.e., 1E10 exosomes/ml etc.). Fractions 7-9 contain >99% purified artificial synapses. Fractions 7-9 are pooled and may be concentrated using a filtration device, for example a 10K MWCO Amicon centrifugal filter. Final purified product may be filtered through a low protein binding filter, for example a 0.2 μm or 0.45 μm PES filter.

FIG. 8 shows hPD-L1 Expression on exosomes, quantity and hPD-L1 concentration was determined in size exclusion chromatography fractions 7-9. Knowing the molecular weight of engineered hPD-L1, the Inventors can determine the number of hPD-L1 molecules per exosome to be approximately between 12 and 40 hPD-L1/exosome. This value is consistent between different purification runs and constructs.

FIG. 9 shows the purification of hPD-L2-Fc-GPI artificial synapses engineered from exosomes via multimodal resin marketed for exosome purification. This graph shows Abs 280 of fractions and quantity of hPDL2 in indicated fractions. Exosomes eluted in Elution 1. Clean in place (CIP) fractions show bound and eliminated proteins from the Inventors' artificial synapse elution.

FIG. 10 shows purification of hPD-L2-Fc-GPI labeled exosomes via size exclusion column as shown here using size exclusion resin marketed for exosome purification. Fractions containing large molecular weight exosomes (Fractions 7-9) showed high hPD-L2 concentration indicating that the purified exosomes contain hPD-L2-Fc-GPI. Total protein (determined by qBit) and hPD-L1 ng/ml (determined by ELISA) of each fraction is shown in the graph. Lower molecular weight unbound hPD-L2-Fc-GPI eluted at later fractions.

FIG. 11 shows hCTLA4-Fc-GPI exosome purification via size exclusion column as shown here using size exclusion resin marketed for exosome purification. Using size exclusion chromatography, exosomes elute in fractions 7-9. Total protein (determined by qBit) and hCTLA4 ng/ml (determined by ELISA) of each fraction is shown in the graph. Fractions 7-9 are pooled and contain >99% purified exosomes. Pooled exosome fractions may then be concentrated using a filtration device, for example a 10K MWCO Amicon centrifugal filter. Final purified product may be filtered through a low protein binding filter, for example a 0.2 μm or 0.45 μm PES filter. Knowing the molecular weight of engineered hCTLA-4, the Inventors can determine the number of hCTLA-4 molecules per exosome to be approximately 233 hCTLA-4/exosome.

FIGS. 12A-12B. FIG. 12A shows PD-1 Signaling Bioassay Method. The Inventors established a method to validate that PD-L1 and PD-L2 artificial synapses engineered from exosomes can bind to cells expressing PD-1 ligand. To perform this validation method, the Inventors modified the PathHunter PD-1 Signaling Bioassay from DiscoverX Briefly, the PathHunter PD-1 Signaling Bioassay relies on the well-established PathHunter Enzyme Fragment Complementation (EFC) technology to interrogate receptor activity. EFC consists of a split β-galactosidase (β-gal) enzyme: the Enzyme Donor (ED) and Enzyme Acceptor (EA) fragments which independently have no β-gal activity. However, when forced to complement they form an active β-gal enzyme that will hydrolyze substrate to produce a chemiluminescent signal. The PathHunter PD-1 Signaling Bioassay consists of human cells engineered to stably express an ED-tagged PD-1 receptor, while EA is fused to the phosphotyrosine-binding SH2 domain of the intracellular signaling protein, SHP'. Ligand or antibody-induced activation of the receptor results in phosphorylation of the receptor's cytosolic tail. Ligand engagement, through addition of ligand-presenting artificial synapses engineered from exosomes, results in phosphorylation of PD-1, leading to the recruitment of SHP1-EA. This forces complementation of the EFC components to create an active β-gal enzyme. This active enzyme hydrolyzes substrate to create chemiluminescence as a measure of receptor activity. Addition of an antagonist (e.g., antibody to PD-L1) blocks PD-1 signaling, and will prevent complementation, resulting in a loss of signal. FIG. 12B shows that the Inventors obtained approximately 10,000× higher increase in Relative Light Units (RLU) in Jurkat signaling cells treated with PD-L1 or PD-L2 labeled artificial synapses when compared to soluble PD-L1-Fc or PD-L2-Fc ligand, respectively. Meaning, it took 10,000× less ug/ml of PD-L1 or PD-L2 on artificial synapses than solubilized PD-L1-Fc or PD-L2 ligand to achieve the same RLU signaling. Shown is a dose-response curve for the PD-L1 and PD-L2 artificial synapses engineered from exosomes vs soluble PD-L1 and PD-L2 signaling bioassay.

FIG. 13A-13C. FIG. 13A shows experimental EAU outline Test Agent A—unmodified exosomes, Test Agent B—mPDL1-Fc-GPI artificial synapses engineered from exosomes 40 ug/ml, Test Agent C—mPDL1-Fc-GPI artificial synapses engineered from exosomes 400 ug/ml, IRBP—interphotoreceptor retinoid-binding protein (IRBP) peptide, BID—Bis in die (2× daily) p.o.—Per os (orally) FIG. 13B shows that EAU symptoms appear at day 6. 1st intravitreal injection and 2nd intravenous injections are performed on Day 6. There is a statistically significant initial reduction in EAU in mouse PD-L1 (mPD-L1) artificial synapses engineered from exosomes treated rats via either the intravitreal and intravenous delivery modes. 2nd intravitreal and 3rd intravenous injections are performed on Day 12. There appears to be a more rapid rate of resolution in the 1× intravitreal and intravenous groups. FIG. 13C shows that weights of rats were monitored throughout the study. 3rd intravitreal and 4th intravenous injections are performed on Day 16. There does not appear to be any significant change in EAU in any of the test groups. The aforementioned results provide proof of principle of successfully treating an autoimmune condition (i.e. EAU) with human cell derived artificial synapses with PD-L1.

FIG. 14 shows 2 types of ligands displayed on the exosome surface (Type I and Type II membrane proteins). Type I membrane proteins wherein the N-Terminus is on the luminal (interior) side of the exosome membrane and the C-Terminus is on the exterior of the exosome.

Type II membrane proteins wherein the N-Terminus is on the exterior while the C-Terminus is on the interior.

FIG. 15 shows a schematic representation of several embodiments of Type I membrane protein constructs, which include but are not limited to: PD-L1, PD-L2, FGL1, OX40L.

FIG. 16 shows a schematic representation of several embodiments of the surface of an extracellular vesicle engineered with a Type I membrane protein of interest (POI) with a variable membrane anchor. Vesicle targeting sequences such as select sequences from 4F2 (CD98), ADAM10, CD298, TFR2, transmembrane potions of CD9, MARCKS, KRAS, and GPI from CD55. Proteins engineered to include a targeting sequence domain may include one or more linkers between the sticky binder and signaling domain (e.g., an Fc linker or a bond sequence wherein the bond sequence may be dimerization or multimerization sequence).

Figure 19:
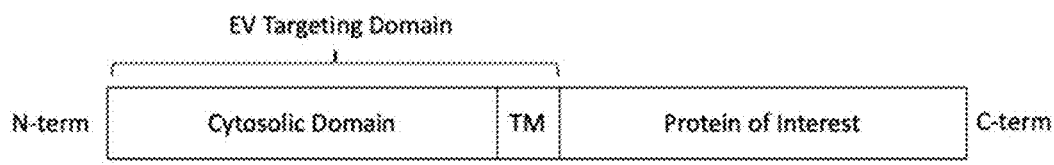

FIG. 19 demonstrates a construct design for labeling an exosome surface with Type II membrane proteins.

Figure 20:
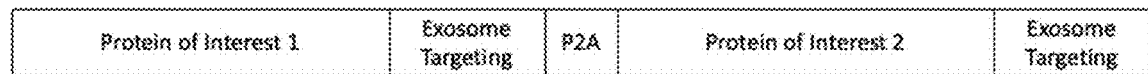

FIG. 20 shows a schematic representation of a construct design for labeling an exosome surface with multiple POI domains operably linked by a cleavable (e.g., P2A) linker.

Figure 21:
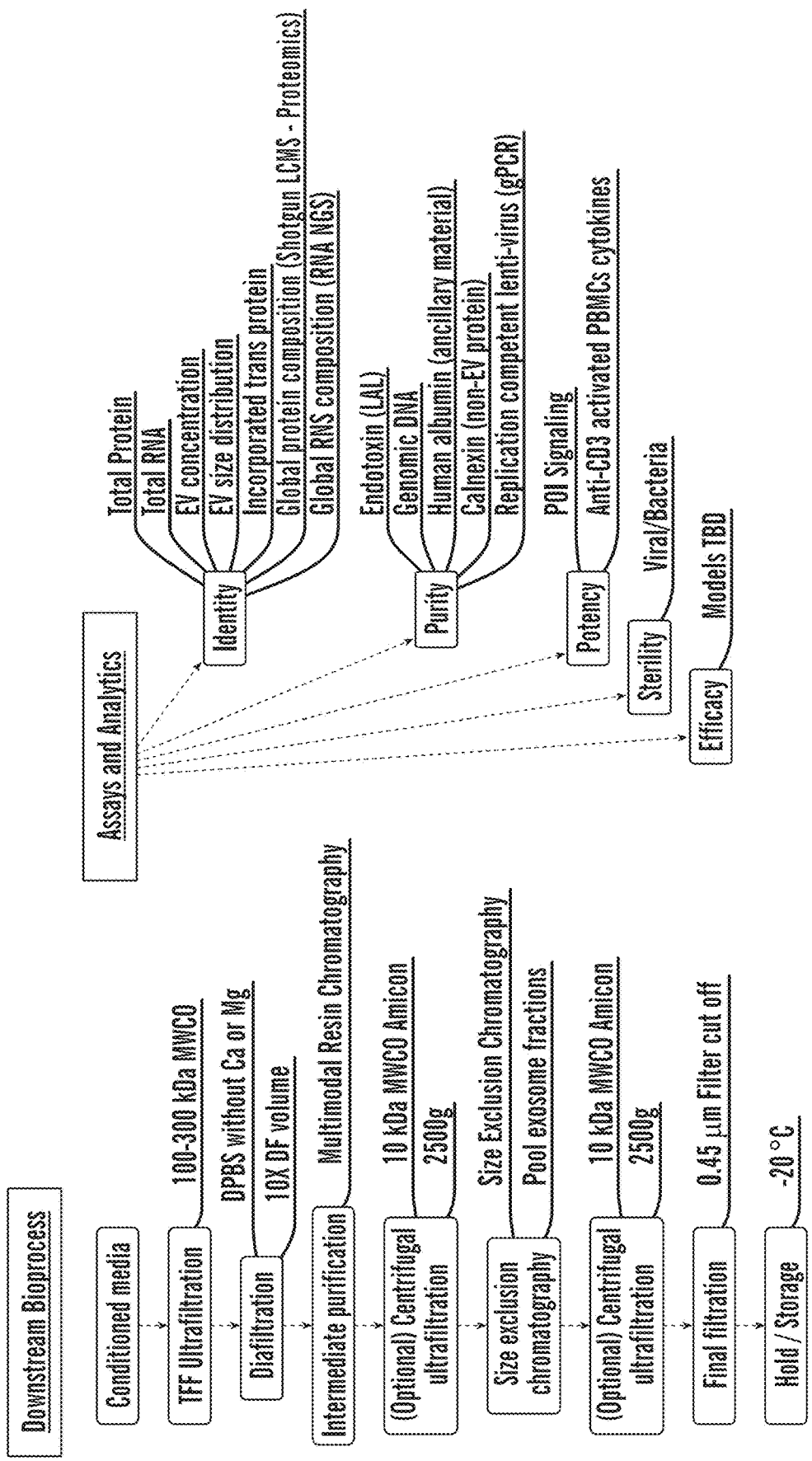

FIG. 21 shows a flow chart of purification and analytical processes provided herein.

Figure 22:
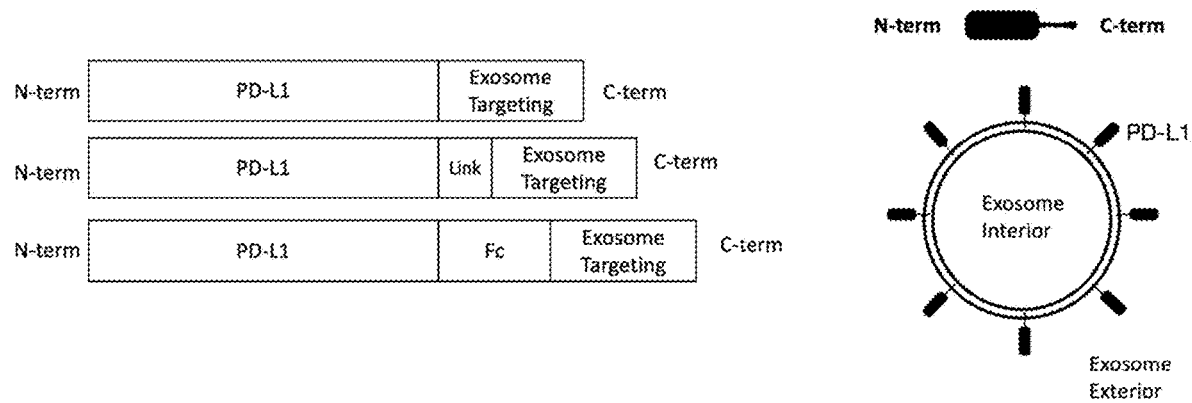

FIG. 22 shows a PD-L1 labeled exosome constructs.

Figure 23:
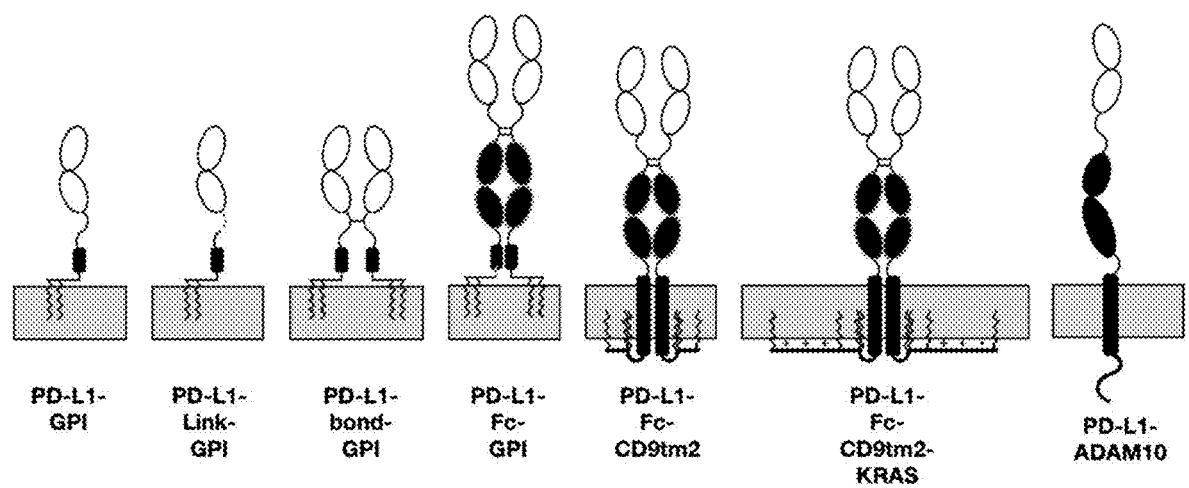

FIG. 23 shows several embodiments of the surface of an exosome engineered with PD-L1. The PD-L1 can be the membrane-bound PD-L1 isotype or secreted PD-L1 (SecPD-L1).

Figure 24:
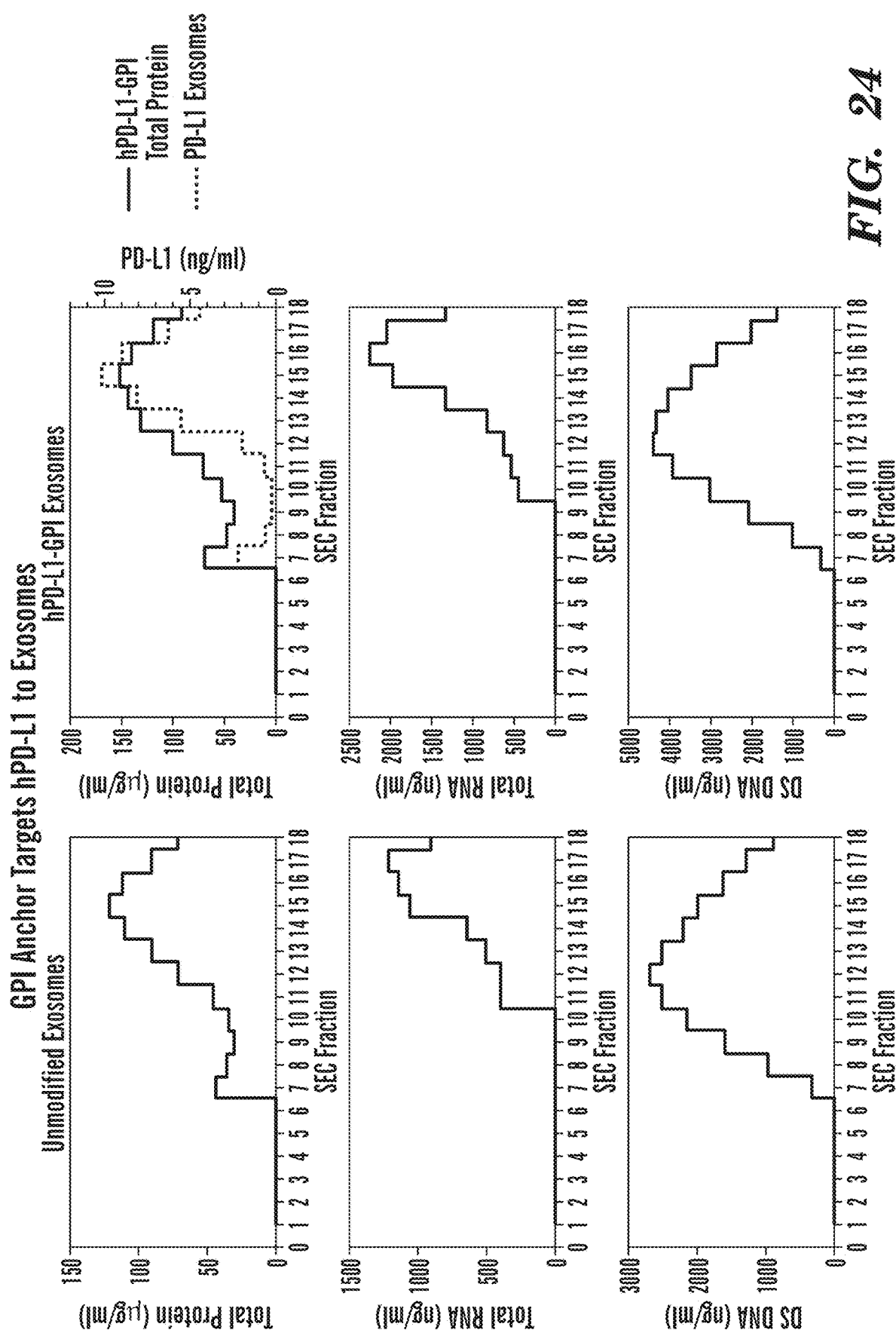

FIG. 24 demonstrates size exclusion chromatography for purifying human PD-L1-GPI (no Fc) exosomes. Left panel: Protein, RNA and DNA measurements in SEC fractions are shown. Invitrogen Qubit fluorometric assays were used to measure biomolecules from unmodified concentrated cell media SEC fractions or hPD-L1-Exo-Tag concentrated cell media SEC fractions. PD-L1 was measured using an R&D systems PD-L1 ELISA kit. Right panel shows dot-blot immunoblot analysis of SEC fractions. A 96-well dot blot apparatus was used to immobilize 50 ul of each SEC fraction onto PVDF. Right bottom figures: Exosome size and concentration was measured in fraction 7 by tunable resistive pulse sensing (TRPS).

Figure 25:
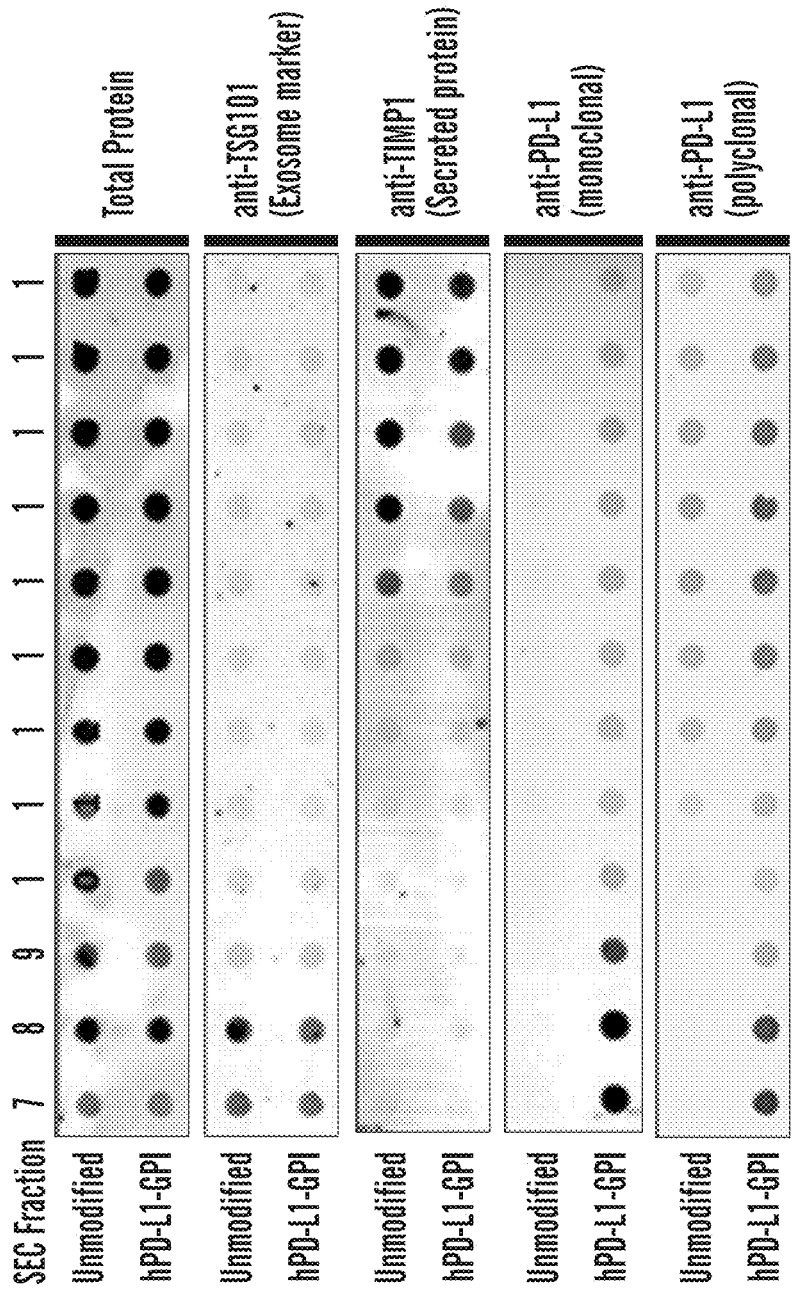
Figure 25:
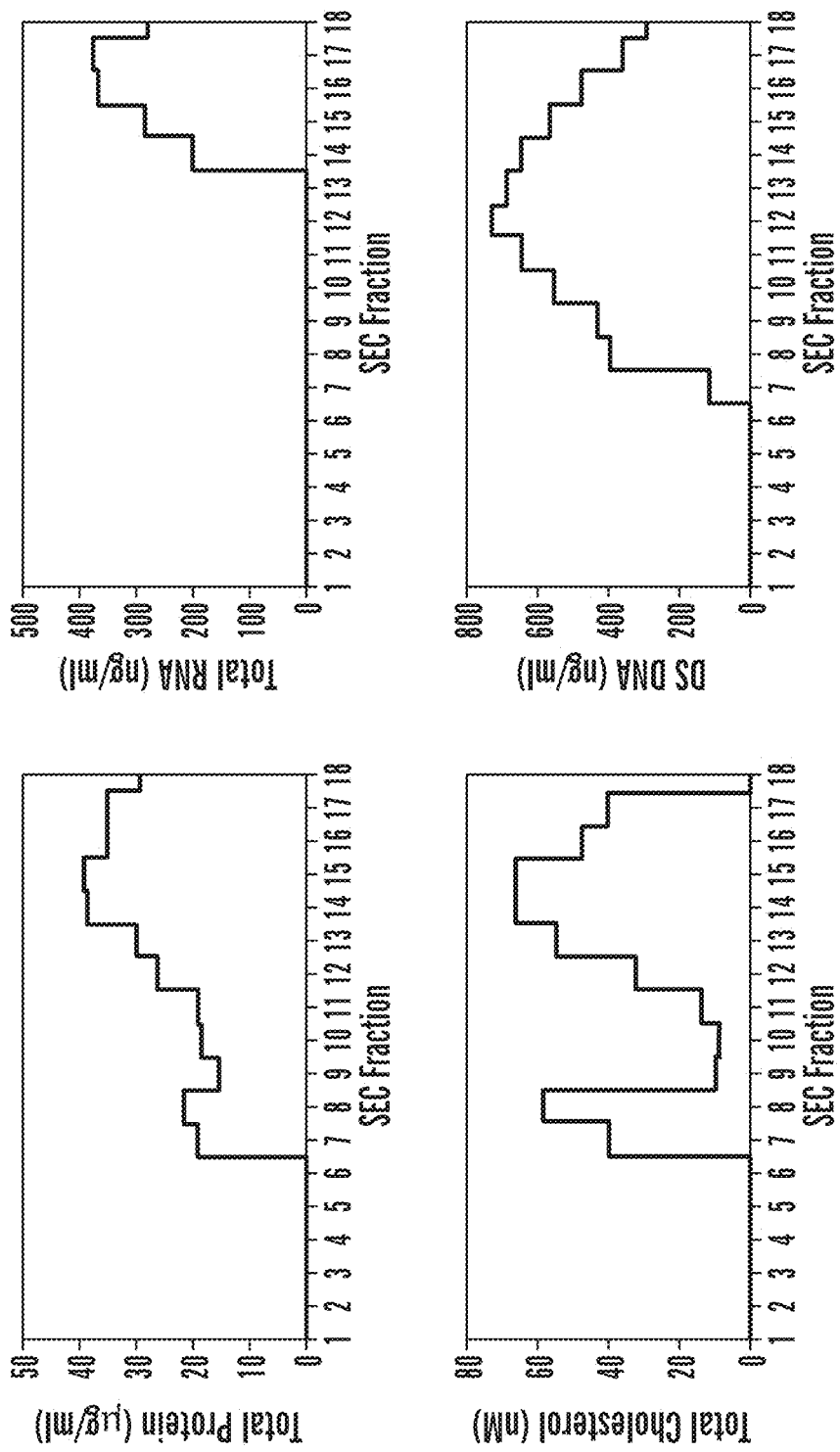
Figure 25:
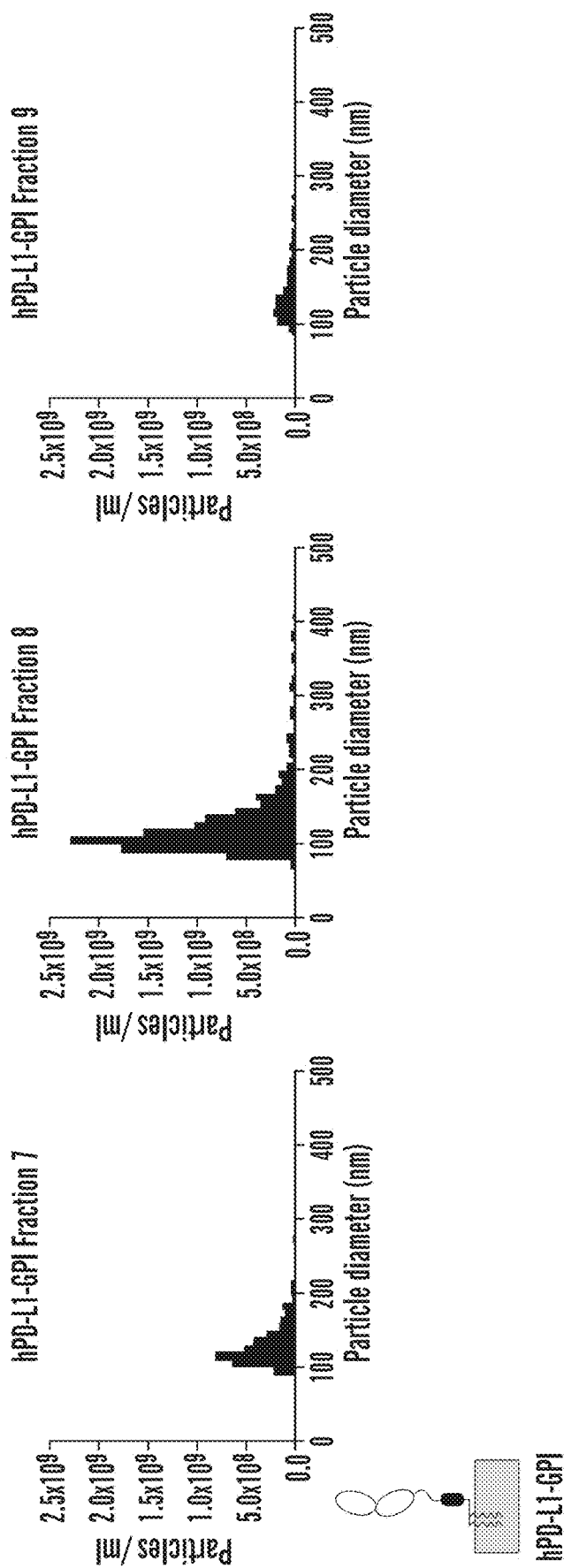

FIG. 25 demonstrates that GPI anchors hPD-L1 on exosomes.

Figure 26:
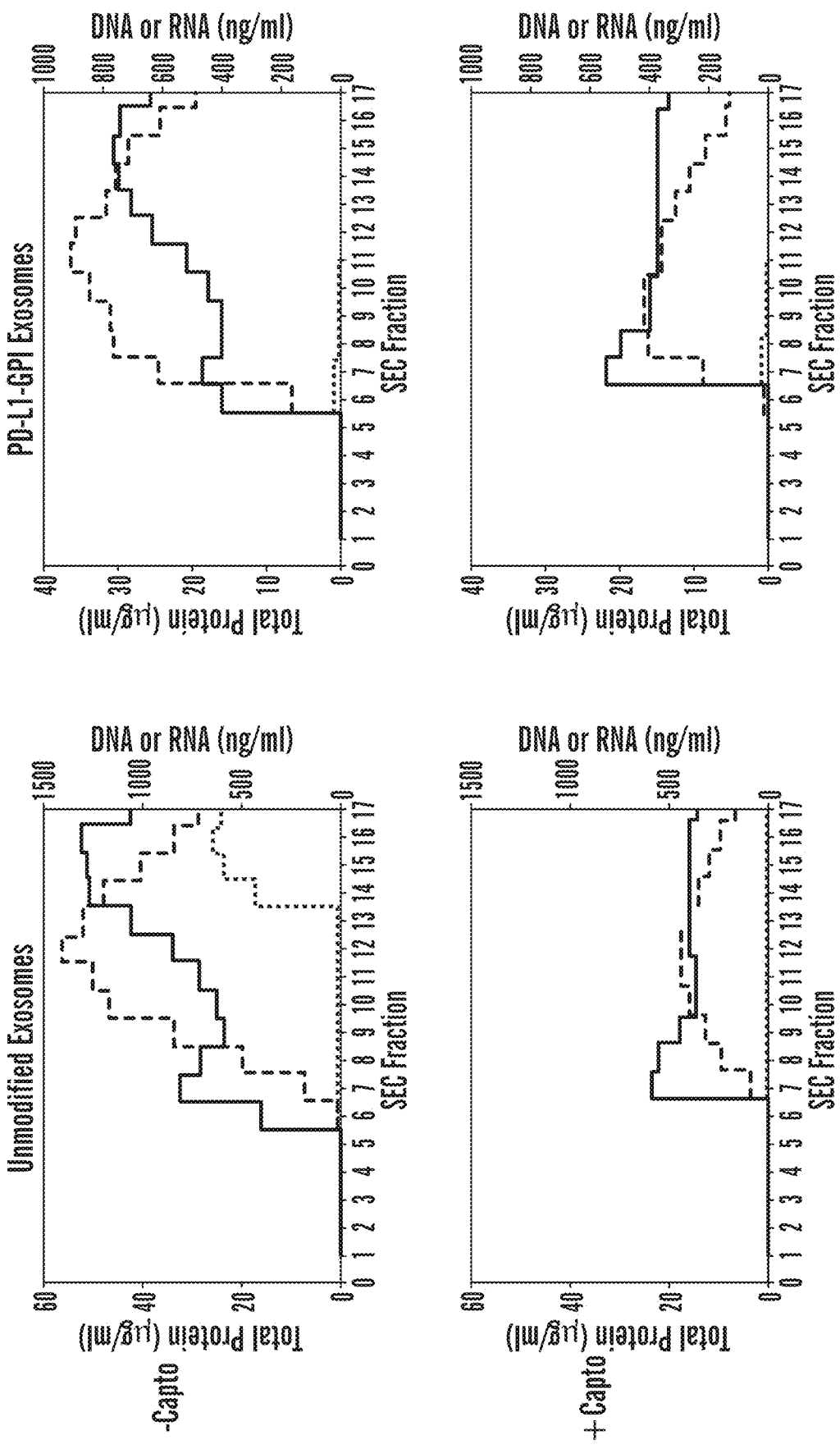
Figure 26:
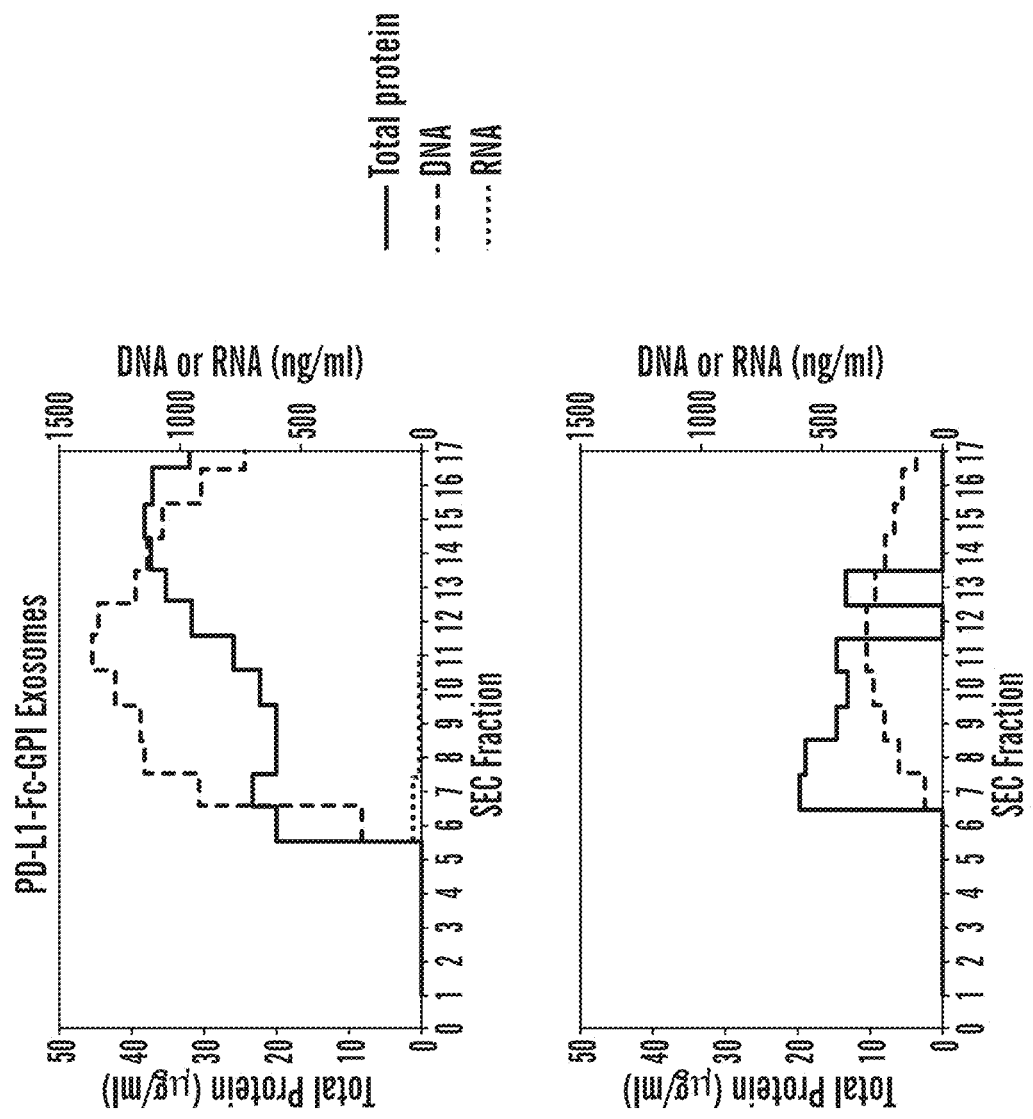
Figure 26:
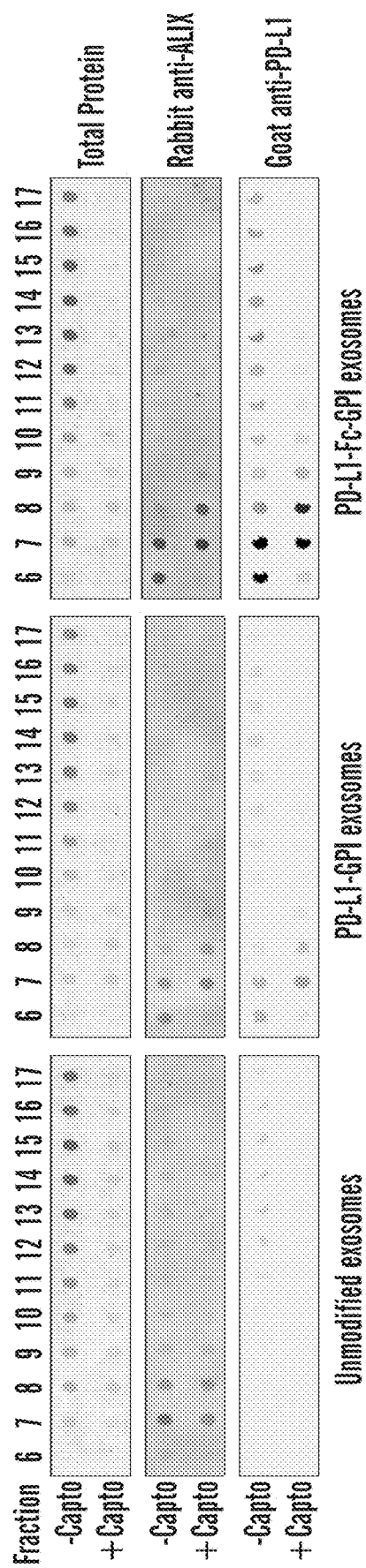

FIG. 26 demonstrates that a multimodal resin marketed for exosome purification purifies and disaggregates exosomes.

Figure 27:
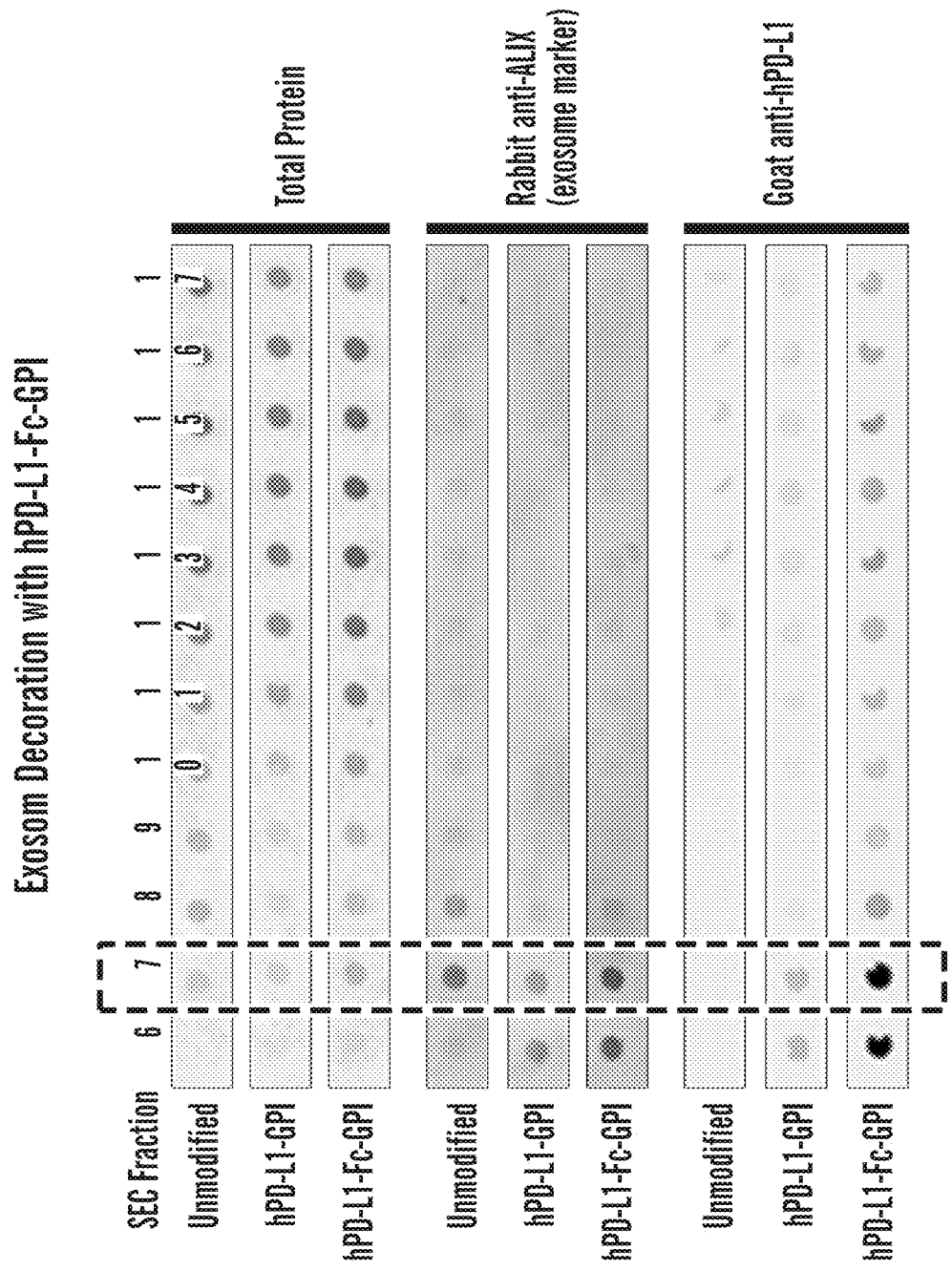
Figure 27:
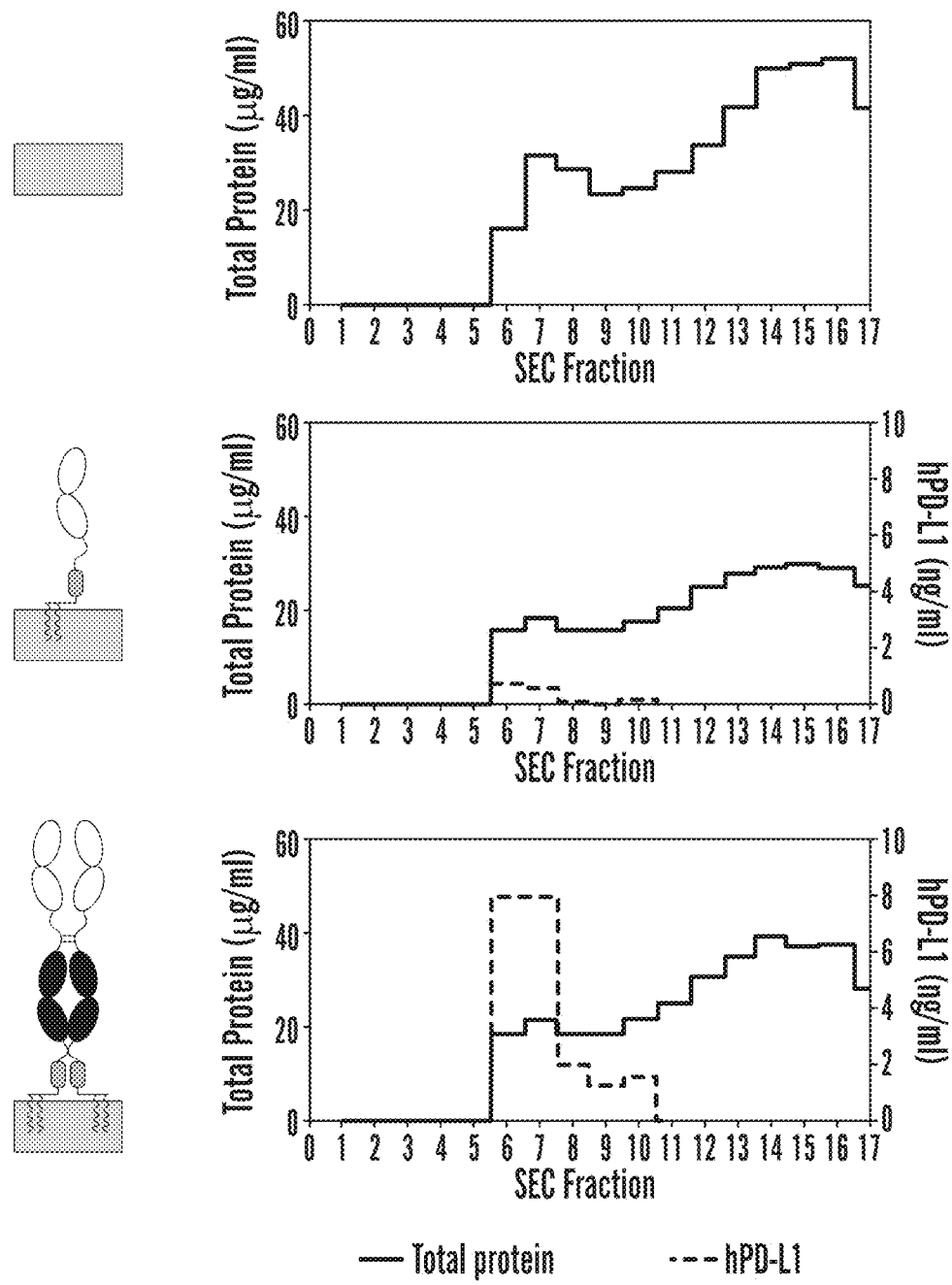

FIG. 27 shows the exosome decoration with hPD-L1-Fc-GPI.

Figure 28A:
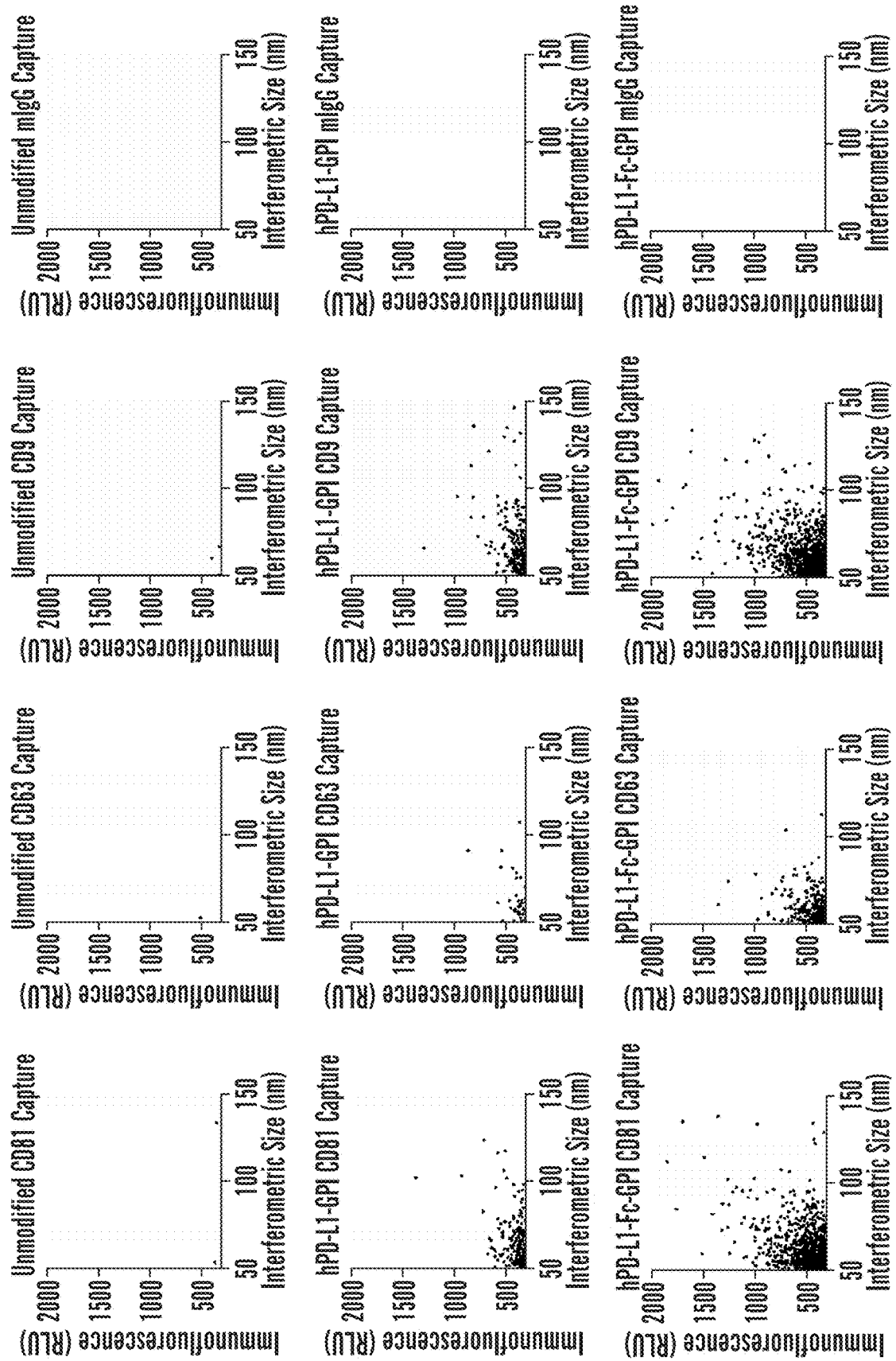
Figure 28B:
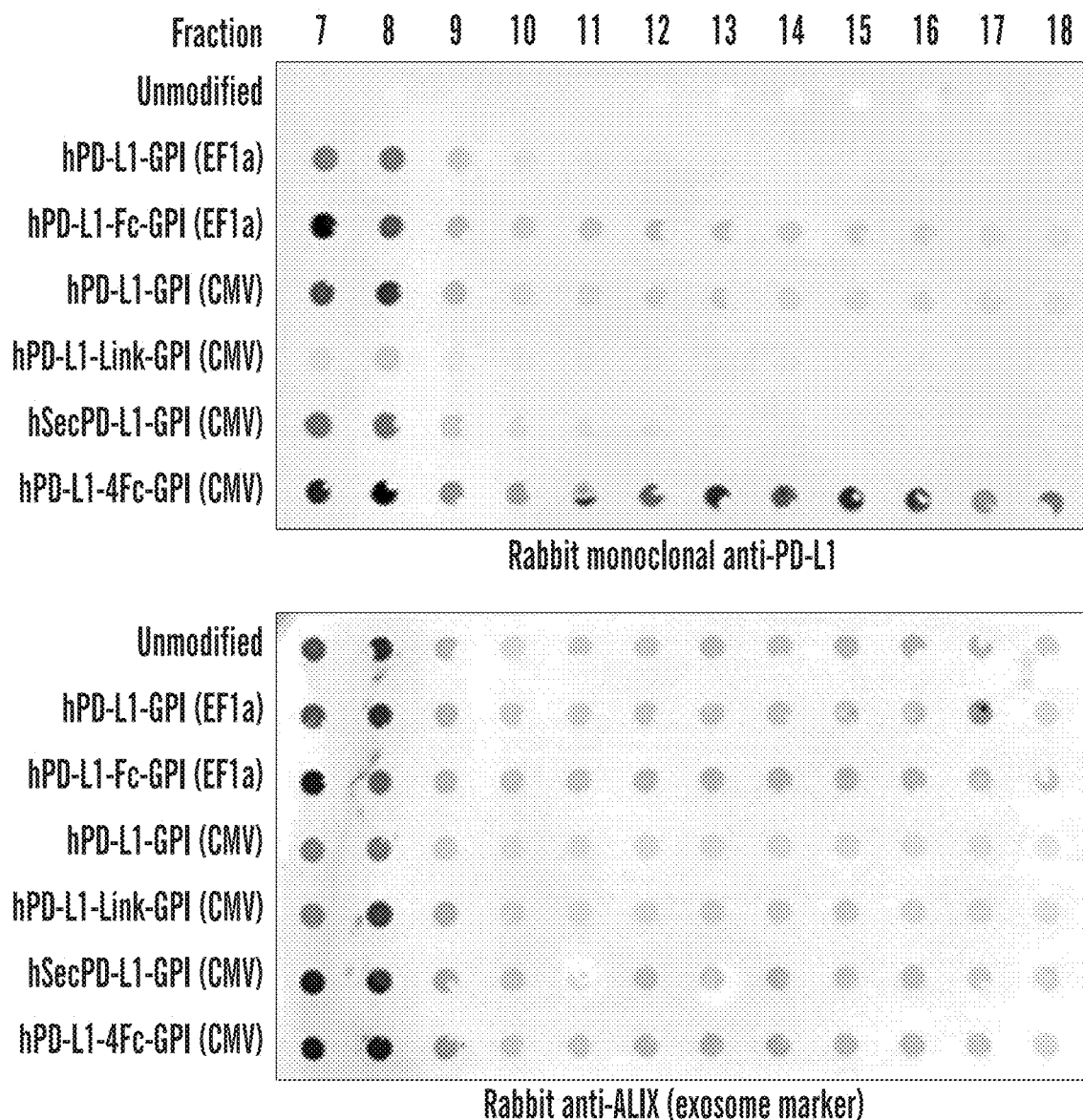
Figure 28B:
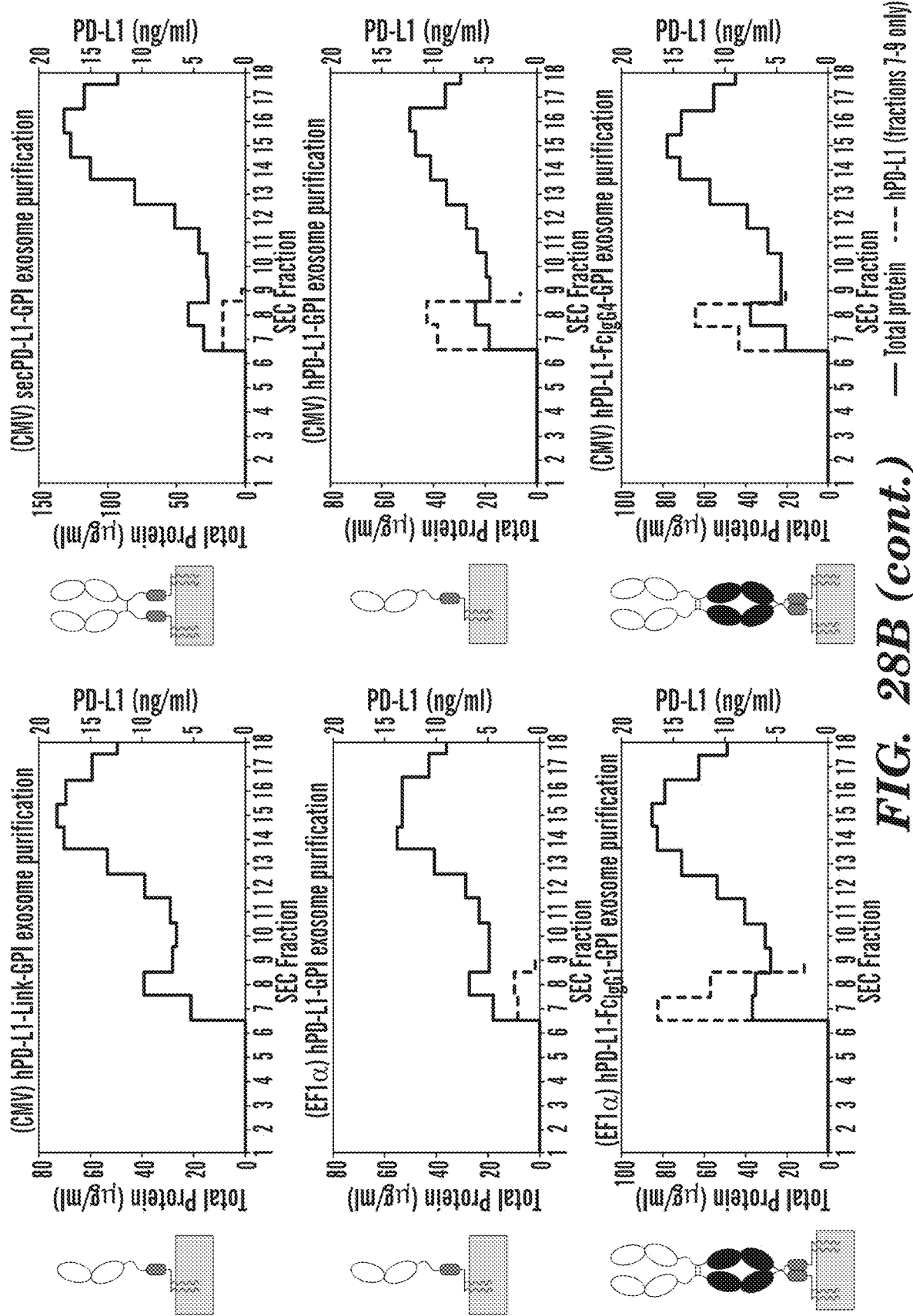

FIGS. 28A-28B. FIG. 28A shows the exosome decoration with hPD-L1-Fc-GPI. Fraction 7 contained the purified hPD-L1-Fc-GPI vesicles. FIG. 28B shows size exclusion chromatography (SEC) purification results of various embodiments of human PD-L1 displayed on the surface of extracellular vesicles.

Figure 29:
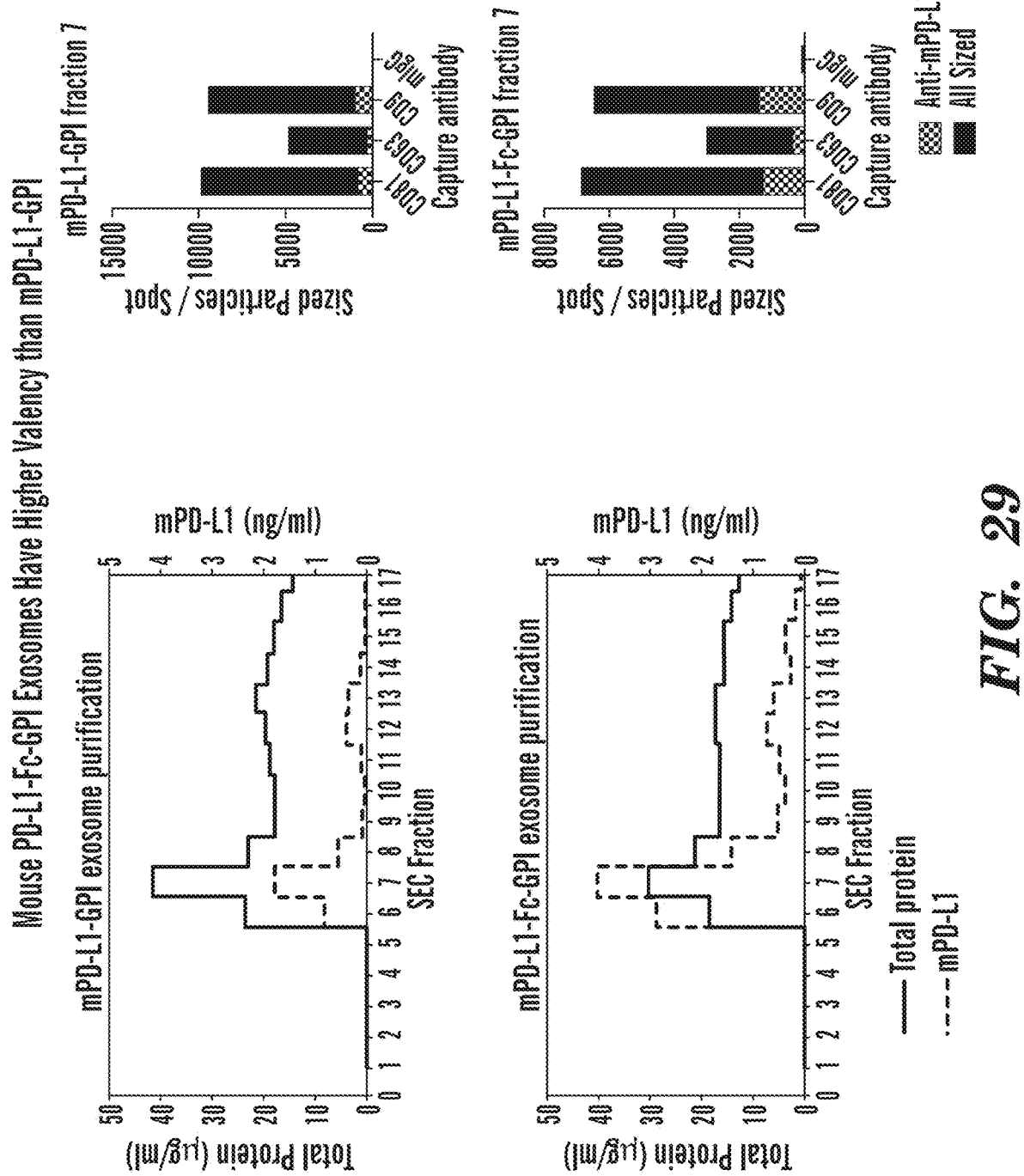
Figure 29:
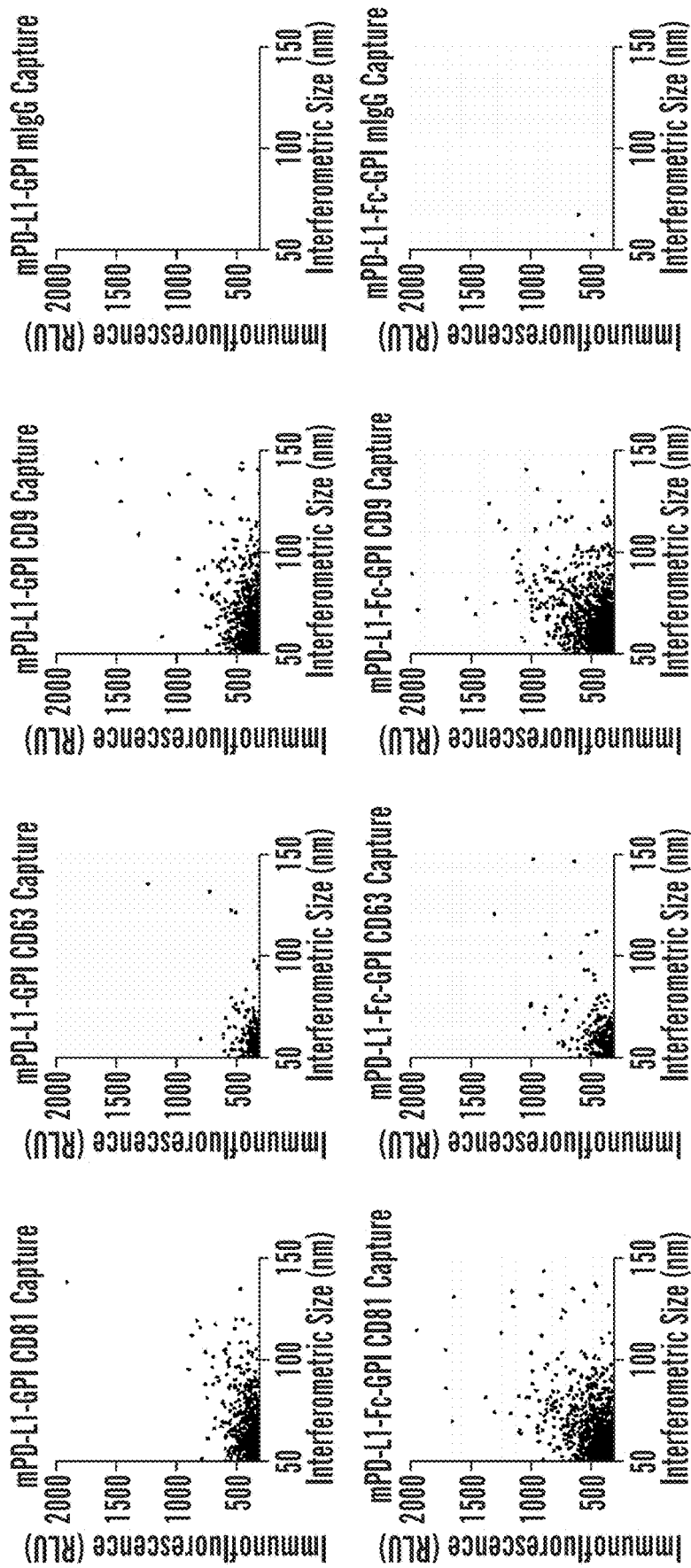

FIG. 29 shows that mouse PD-L1-Fc-GPI exosomes have higher valency than mPD-L1-GPI.

Figures 30A, 30B, 30C:
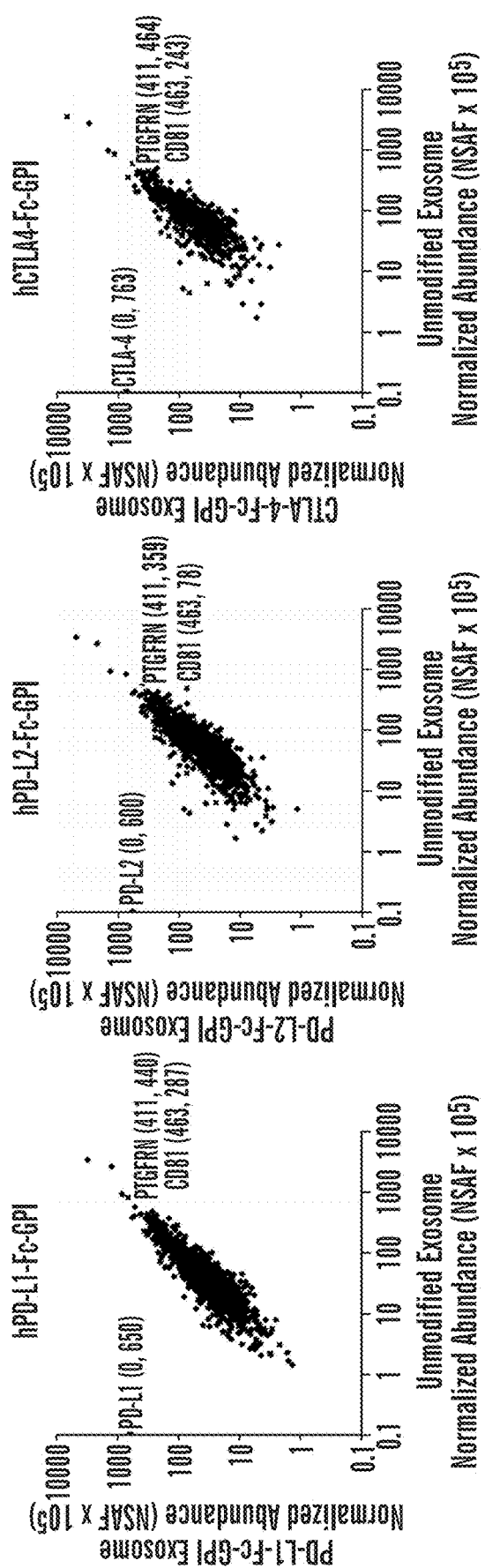

FIG. 30A-30C demonstrates comparison proteomics of transprotein expression and shows that surface labeling on the engineered extracellular vesicles provided herein do not affect the relative expression of native and associated exosome proteins. FIG. 30A shows hPD-L1-Fc-GPI. FIG. 30B shows hPD-L2-FcGPI. FIG. 30C shows hCTLA4-Fc-GPI.

Figure 31:
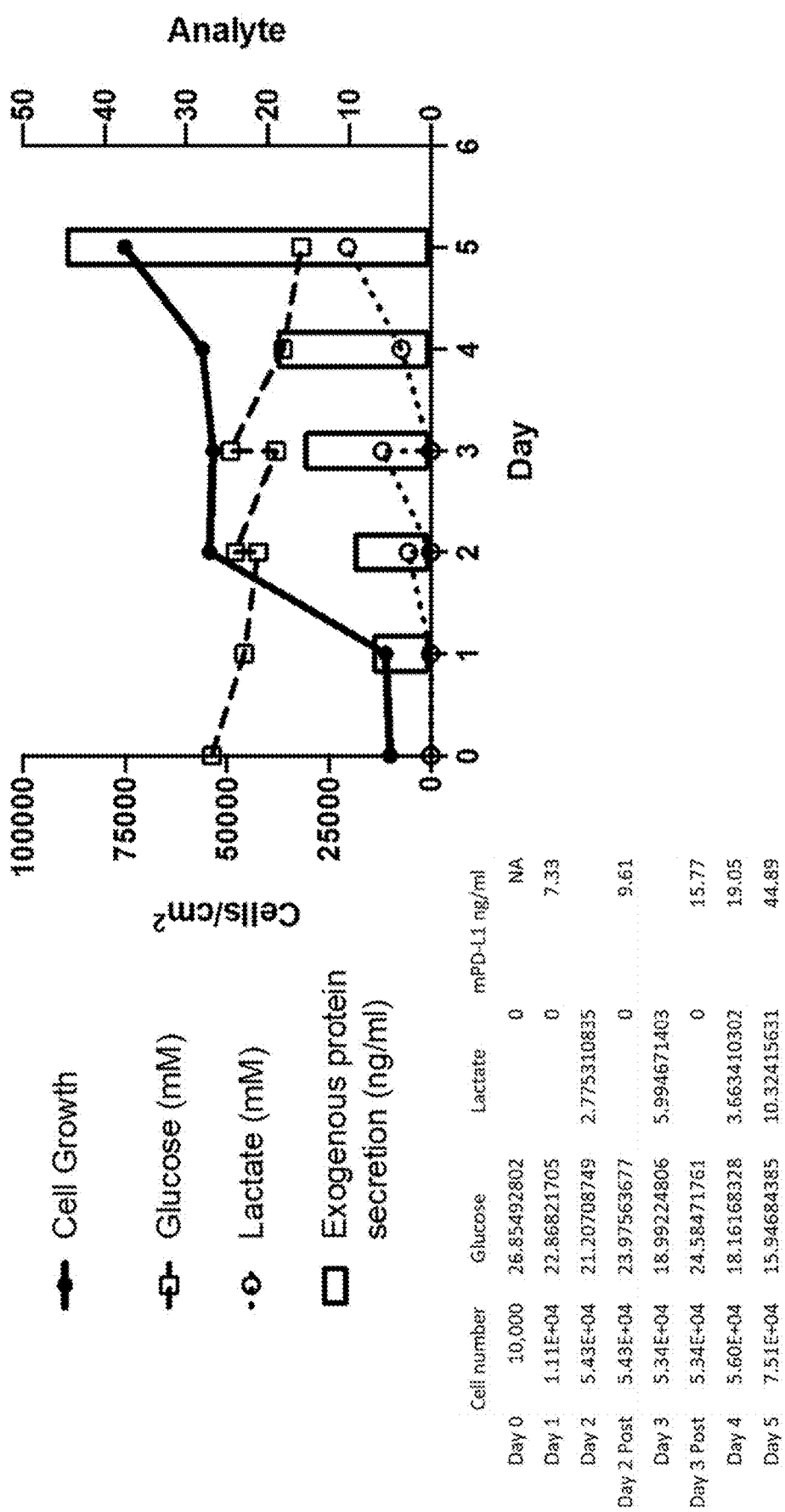

FIG. 31 shows production of mPD-L1-Fc-GPI in STR Bioreactor.

Figure 32:
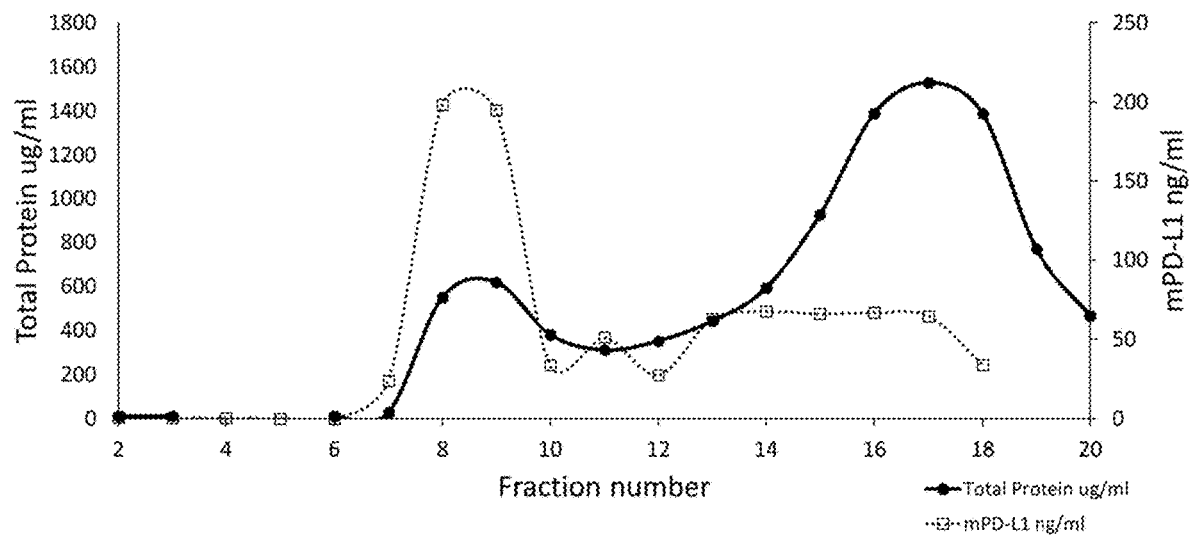

FIG. 32 shows purification of mPD-L1-Fc-GPI (STR) via SEC. Graph shows mPD-L1 ng/ml vs Total Protein ug/ml.

Figure 33:
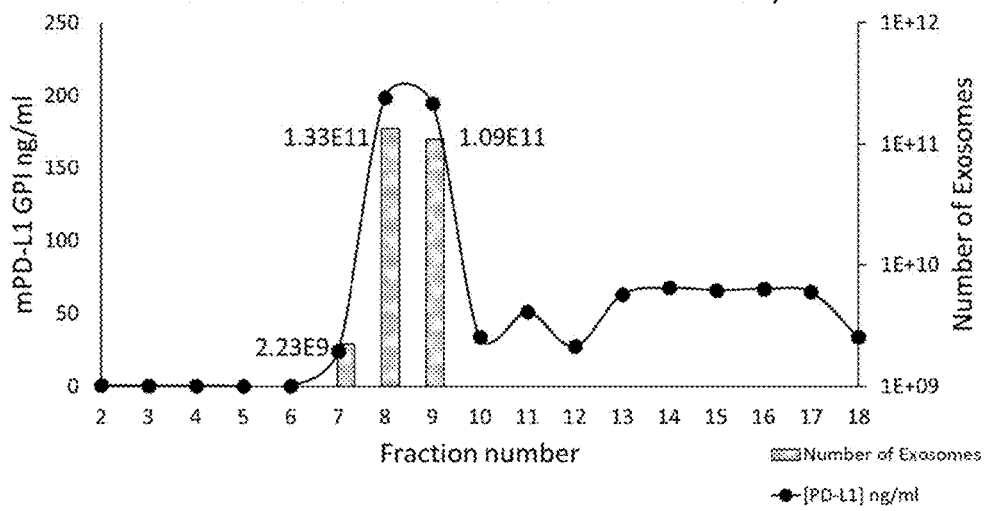

FIG. 33 shows purification mPDL1-Fc-GPI (STR bioreactor).

Figure 34:
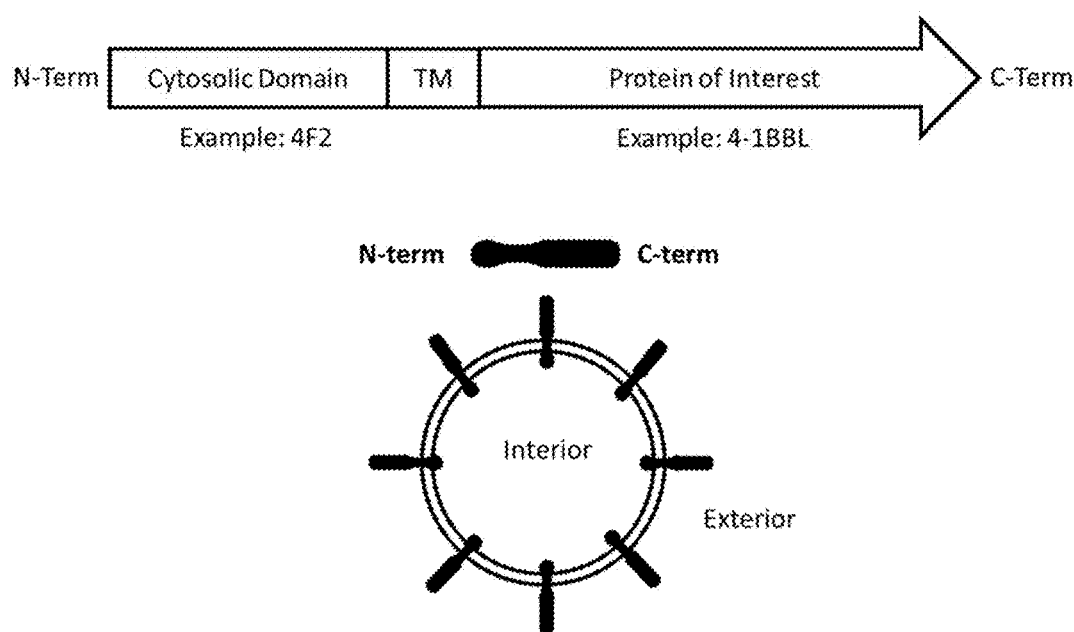

FIG. 34 shows a schematic representation of the 4-1BBL labeled exosomes. Top: Vector map showing the N-terminal cystolic domain, a transmembrane (TM) domain, and the POI domain at the C-terminus. Bottom: An embodiment of an engineered EV with a type-II membrane display of the fusion protein.

Figure 35:
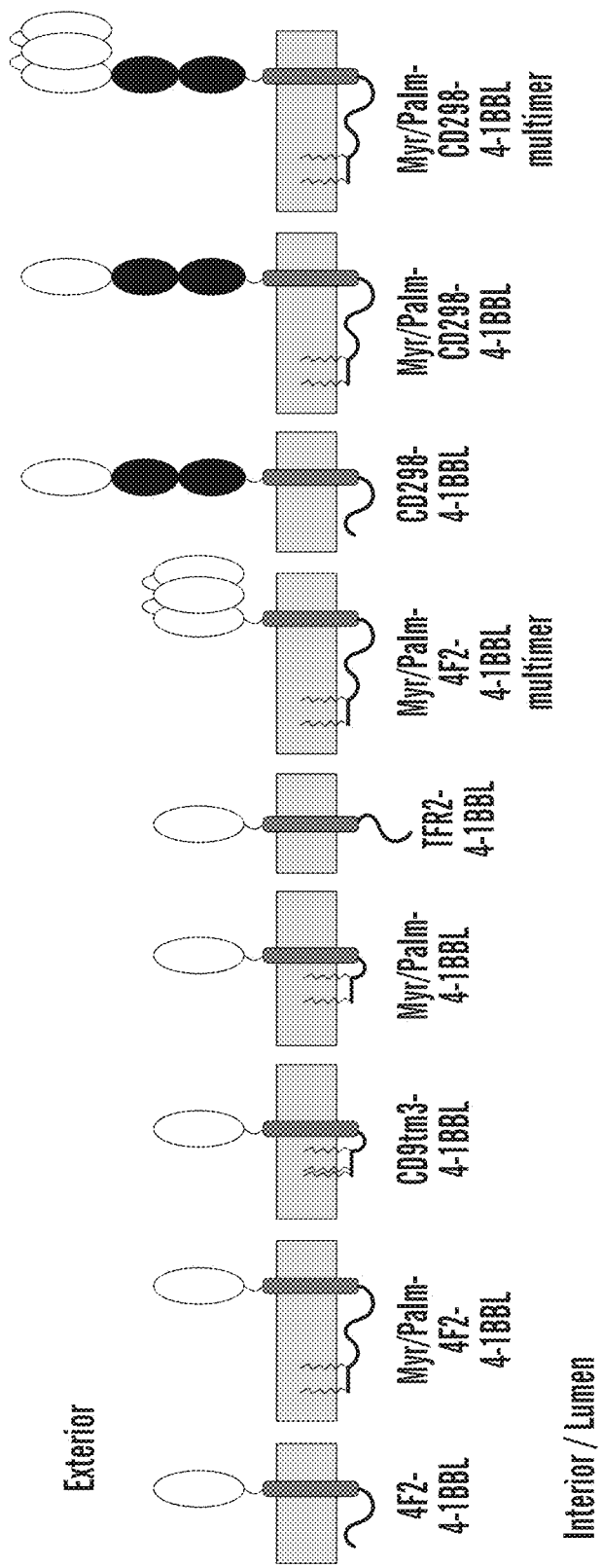

FIG. 35 shows embodiments of a 4-1BBL display exosome.

Figure 36A:
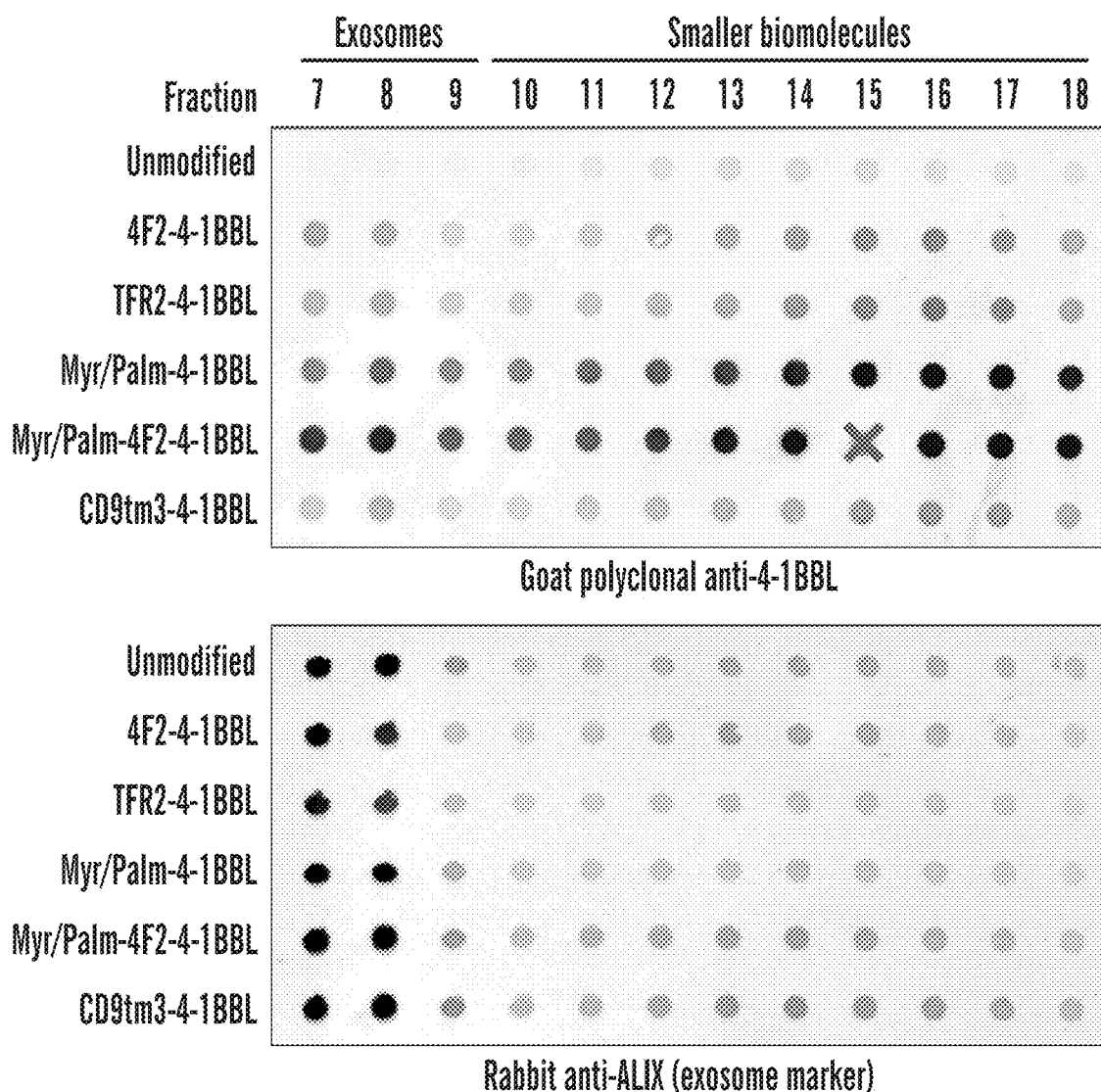
Figure 36A:
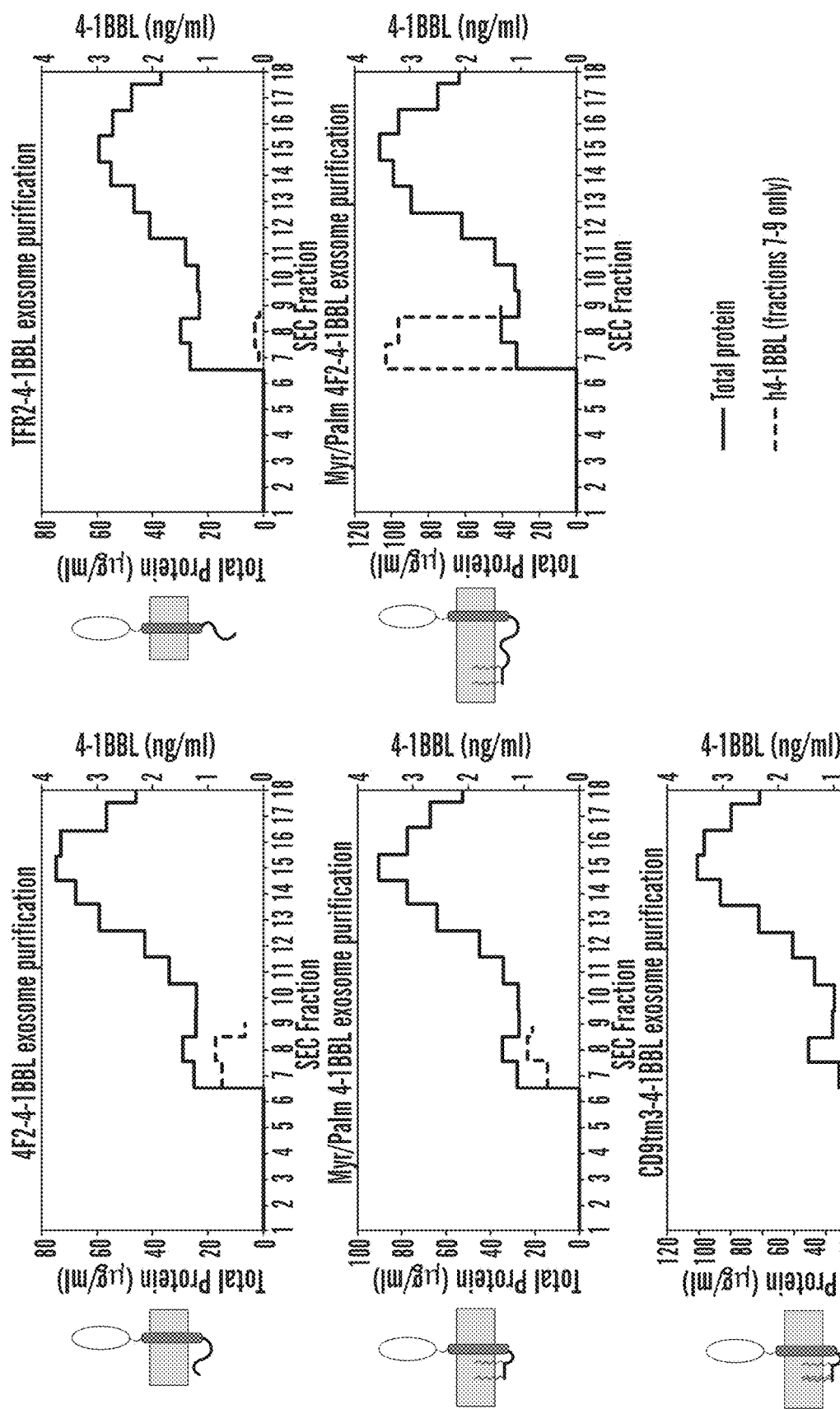
Figure 36B:
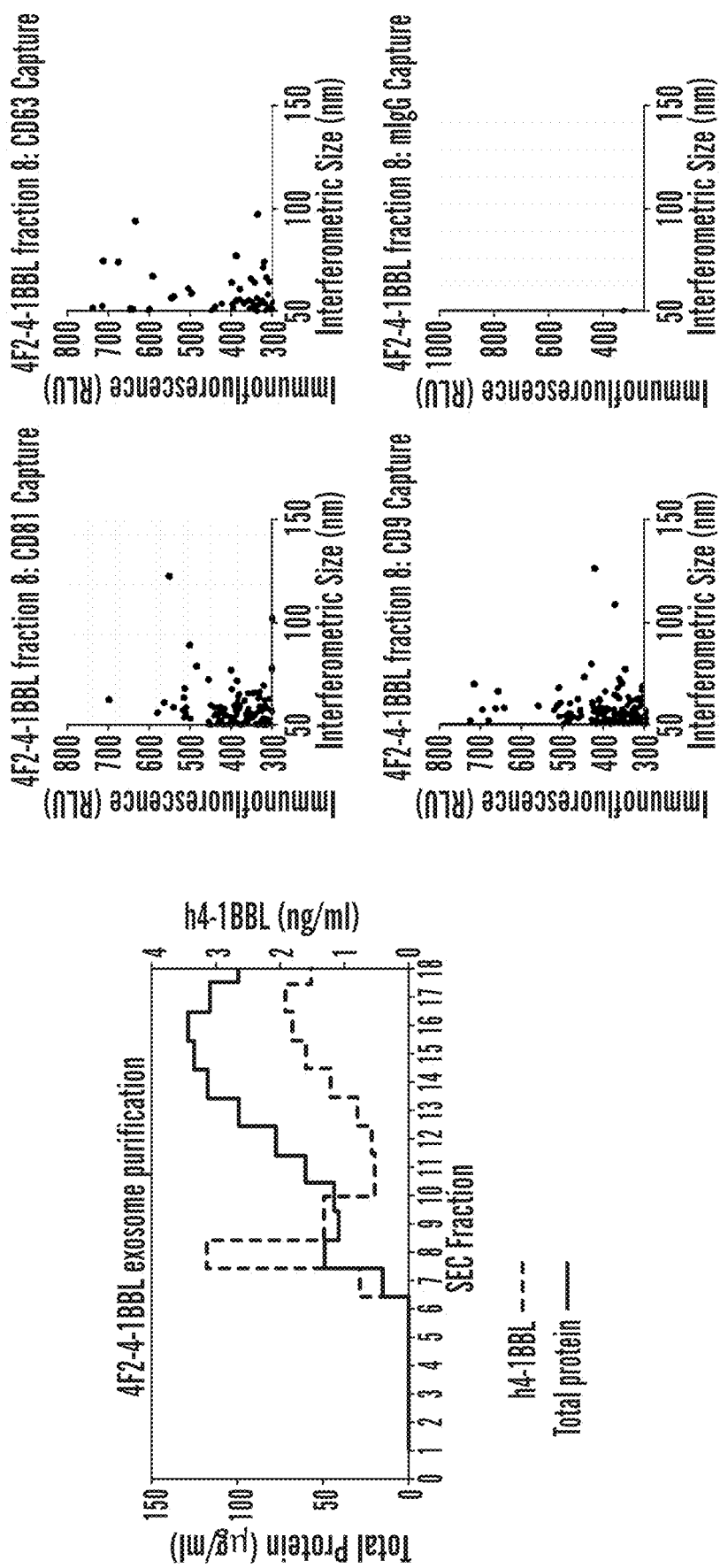

FIG. 36A-36B. FIG. 36A shows the protein engineering and purification of 4F2-4-1BBL labeled exosomes. FIG. 36B confirms that h4-1BBL is displayed on the engineered exosomes.

Figure 37:
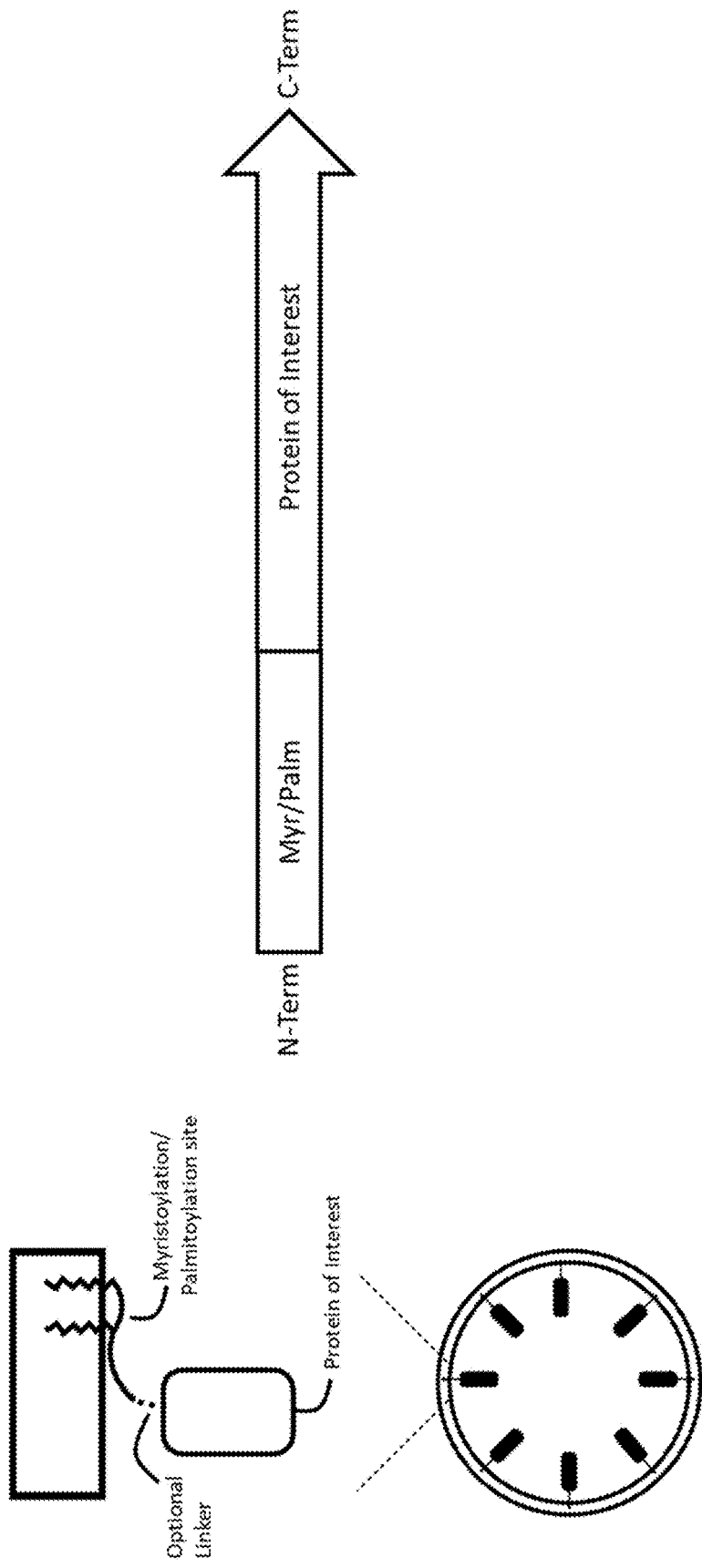

FIG. 37 shows internal fusion protein loading of exosomes.

Figure 38:
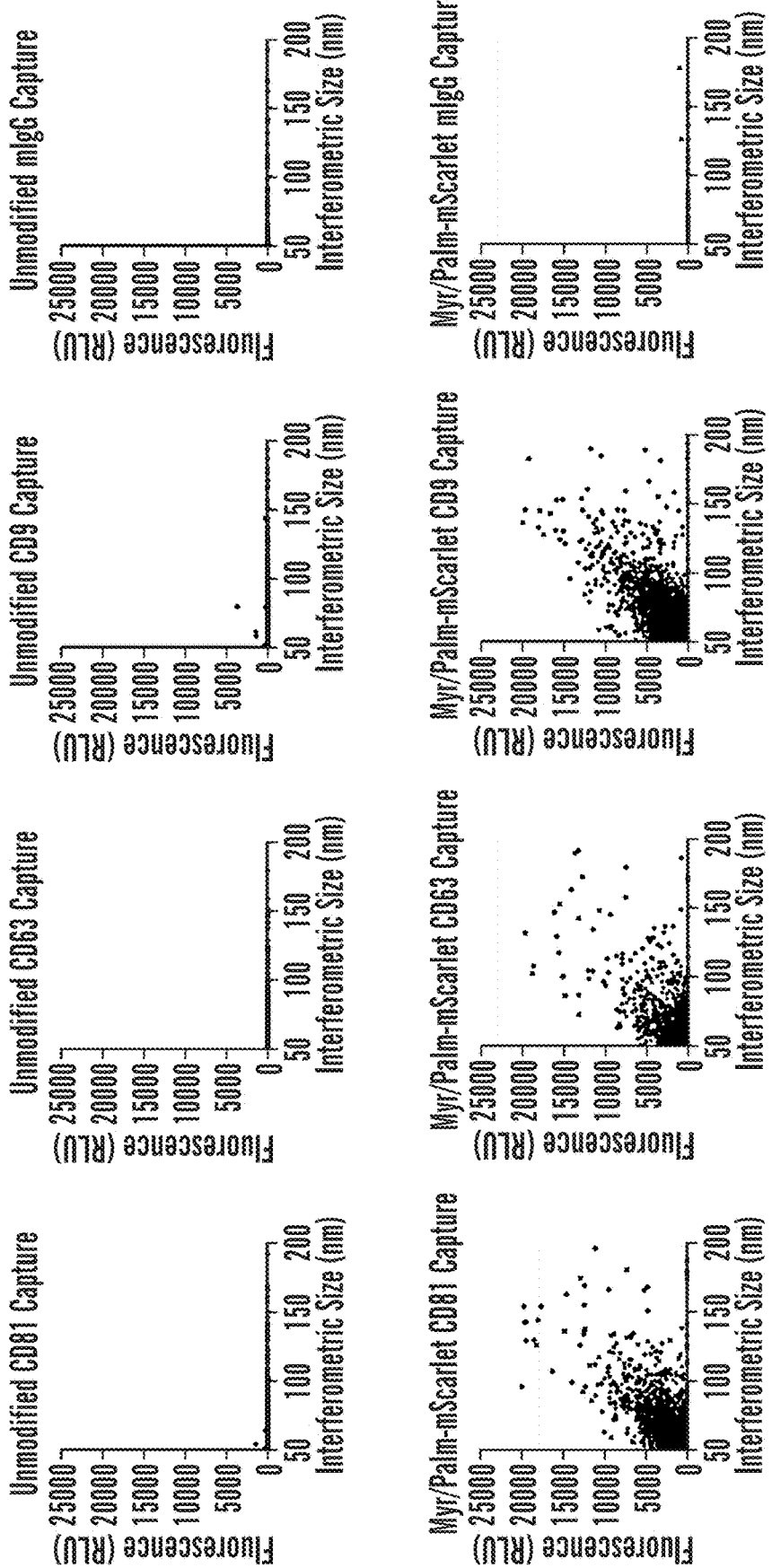

FIG. 38 shows internal loading of exosomes with mScarlet (RFP).

Figure 39A:
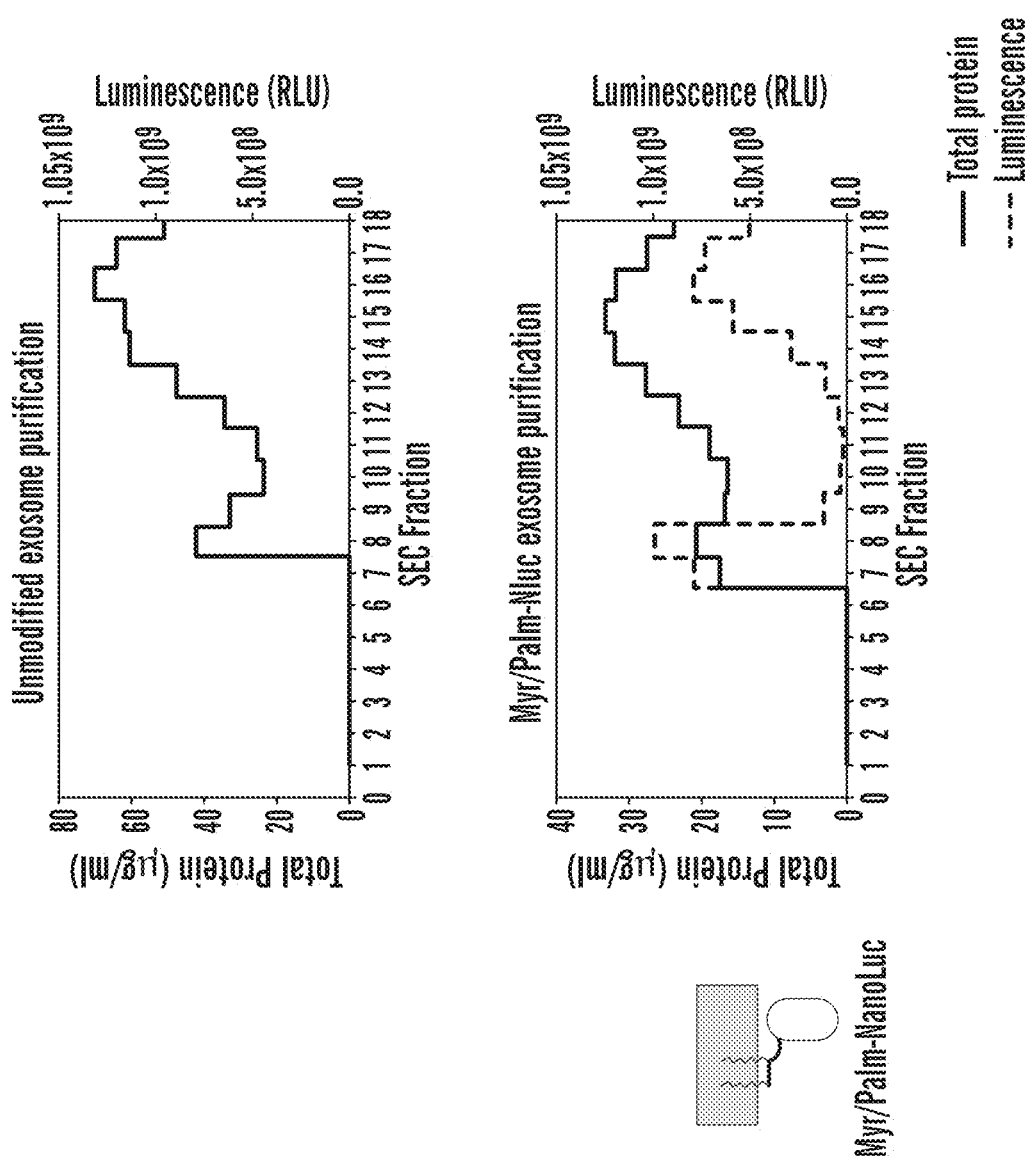
Figure 39B:
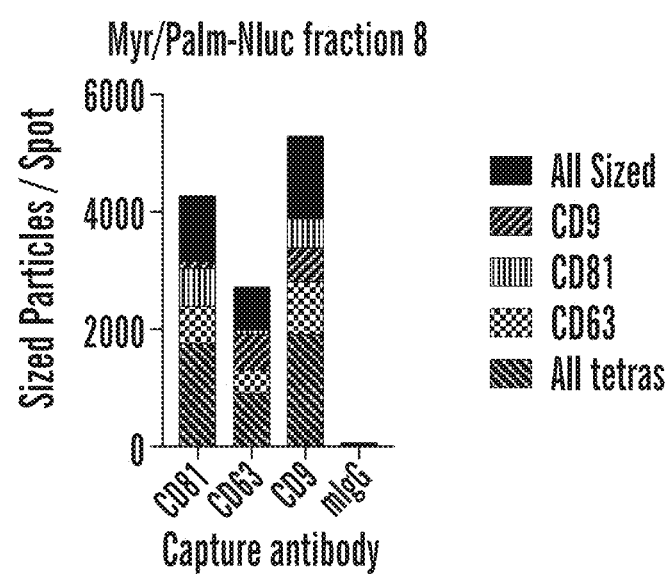

FIGS. 39A-39B. FIG. 39A shows internal loading of exosomes with NanoLuc luciferase. FIG. 39B shows tetraspanin characterization of exosomes internally loaded with NanoLuc luciferase.

Figure 40A:
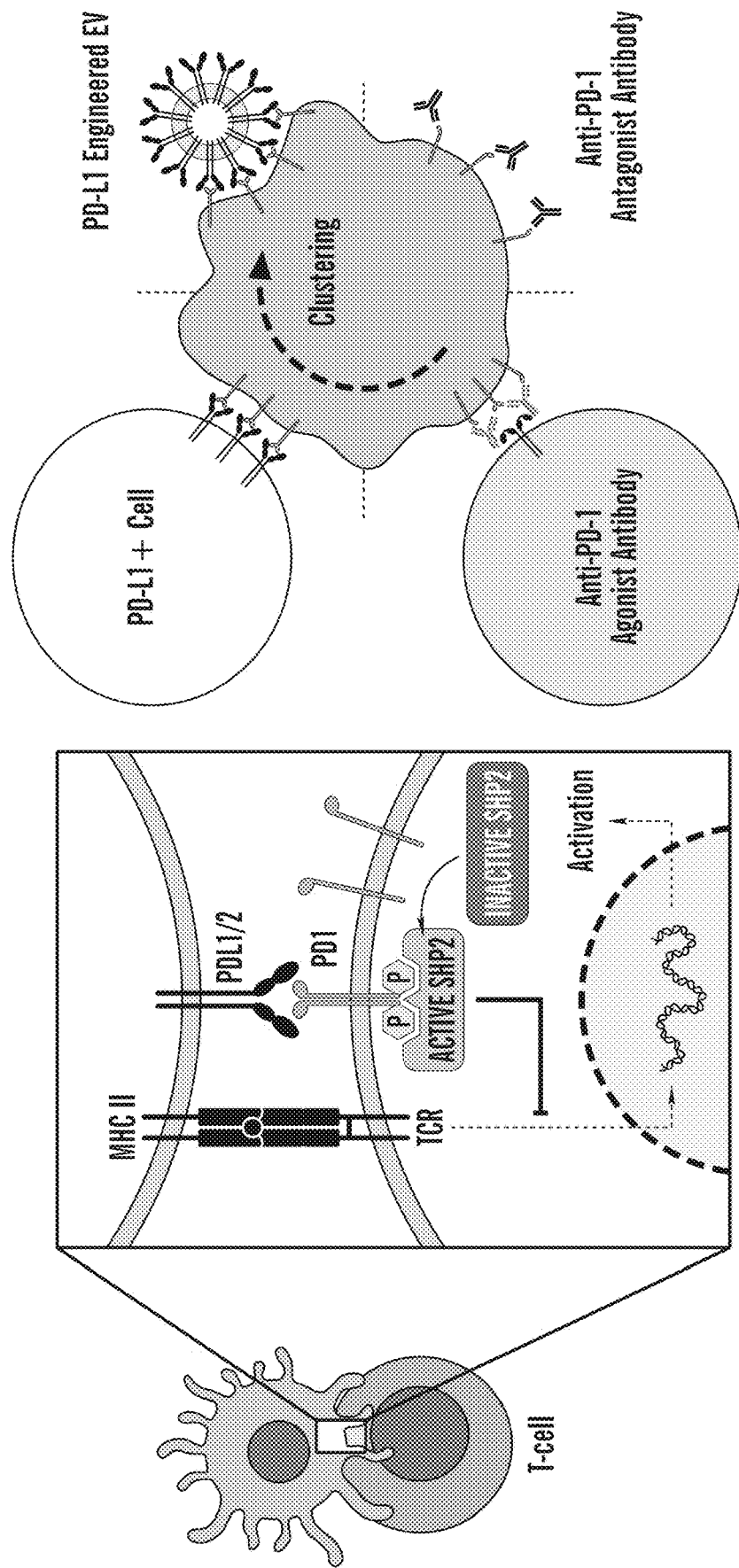
Figure 40B:
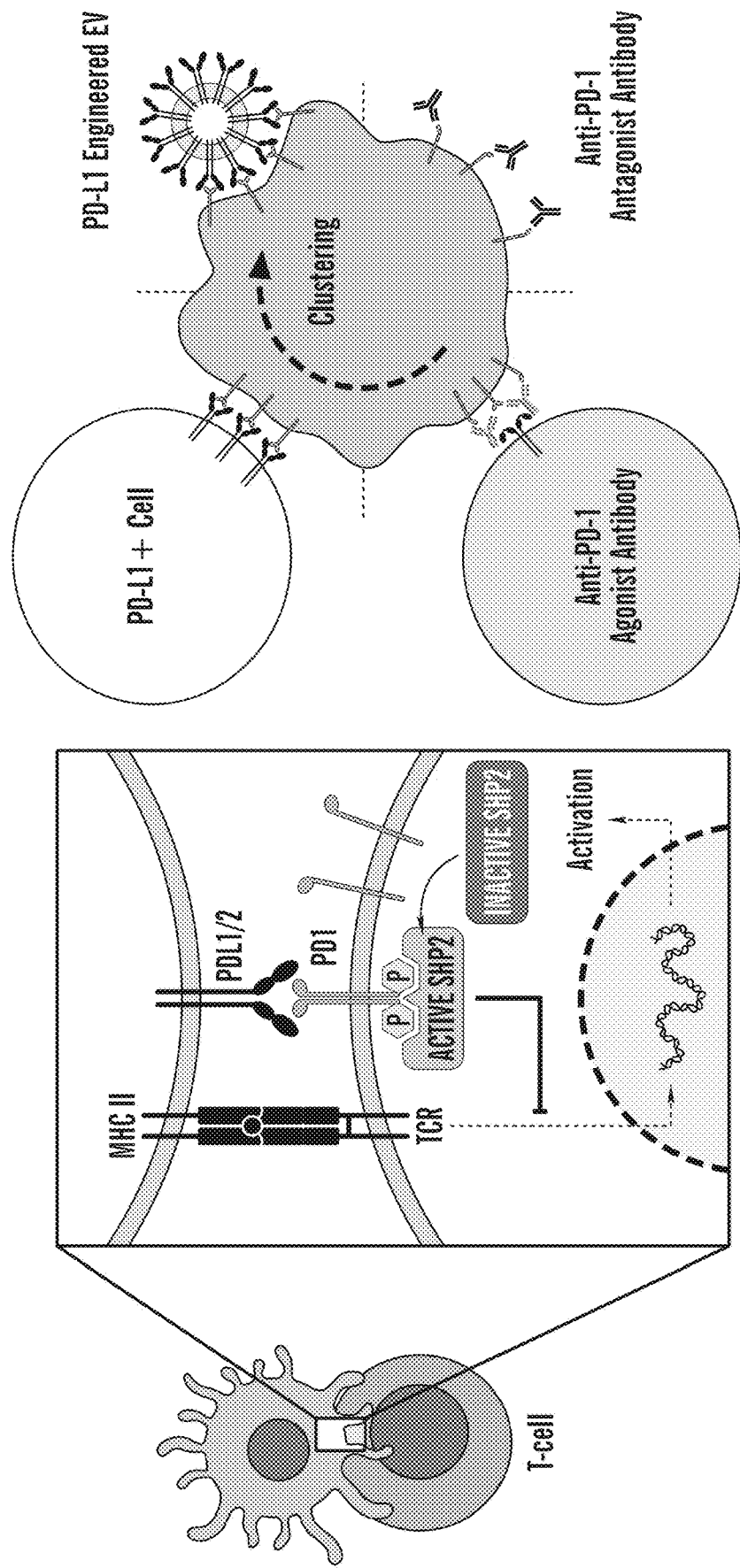

FIGS. 40A-40B. FIG. 40A shows the mechanism of PD-L1 engineered extracellular vesicles induce membrane clustering and receptor agonism on a target cell. An exemplary model of proposed mechanism of extracellular vesicles with a Type I membrane protein signaling domain (PD-L1) promoting receptor clustering on a target cell, wherein receptor clustering promotes increased potency of signal transduction of the target receptor. Antagonist antibodies function well at blocking receptors. Antibodies are poor agonist modalities due to their general inability to cluster receptors. Ligands on a membrane surface are potent agonists, however the cost and cold chain logistics of cell therapies makes commercialization difficult and expensive. Extracellular vesicles engineered with Type I membrane protein are able to induce receptor clustering of target receptors and initiate and propagate a potent signal response on a target cell.

FIG. 40B shows the mechanism of 4-1BBL engineered extracellular vesicles induce membrane clustering and receptor agonism on a target cell. An exemplary model of proposed mechanism of extracellular vesicles with a Type II membrane protein signaling domain (4-1BBL) promoting receptor clustering on a target cell, wherein receptor clustering promotes increased potency of signal transduction of the target receptor. Soluble ligands are often poor agonist modalities due to their general inability to cluster receptors. Ligands displayed on a membrane surface are potent agonists, however the cost and cold chain logistics of cell therapies makes commercialization difficult and expensive. Extracellular vesicles engineered with Type II membrane protein are able to induce receptor clustering of target receptors and initiate and propagate a potent signal response on a target cell.

DETAILED DESCRIPTION

The compositions and methods provided herein are based, in part, on the discovery that engineered extracellular vesicles (e.g., exosomes) expressing an engineered fusion protein (e.g., PD-L1) reduces inflammation in an animal model of experimental autoimmune uveoretinitis (EAU), an autoimmune disorder. The compositions and methods provided herein are further based, in part, on the discovery that engineered extracellular vesicles produce enhanced signaling compared to an equal quantity of recombinant ligand. Since some cellular receptors, (e.g., PD-1) require clustering or super-clustering to promote a signaling response, it stands to reason that extracellular vesicles engineered to express ligands on their surface wherein the ligands may engage target receptors on target cells and promote clustering of said target receptors thereby promoting a signal response on said target cell.

In one aspect, provided herein is an engineered extracellular vesicle comprising: at least one fusion polypeptide comprising: at least one protein of interest (POI) domain; and at least one vesicle targeting domain. In some embodiments of any of the aspects, the engineered extracellular vesicle is an exosome. In some embodiments, of any of the aspects, the fusion protein further comprises at least one linker. In some embodiments of any of the aspects, the POI domain can substantially bind to a target polypeptide. In some embodiments of any of the aspects provided herein, the engineered extracellular vesicle is an artificial synapse.

Generally, the extracellular vesicles (e.g., exosomes) provided herein are produced by contacting a population of cells with a nucleic acid construct encoding the fusion proteins provided herein and isolating a plurality of extracellular vesicles. The extracellular vesicles can then be purified by methods provided herein and are formulated for therapeutic use, including but not limited to, for the treatment of autoimmune diseases, cancer, or modulating inflammation in a subject.

The compositions and methods provided herein are specifically designed to exploit the membrane trafficking mechanisms of extracellular vesicles and rely on the hallmark biophysical and biochemical properties of extracellular vesicles, such as exosomes. The vesicles/artificial synapses provided herein are specifically engineered to induce/agonize and propagate biological signaling via a target polypeptide (e.g., by activating a receptor or enzyme or agonizing said receptor or enzyme). Alternatively, the engineered extracellular vesicles provided herein can act as cellular decoys or to reduce or antagonize biological signaling, e.g., by blocking an endogenous ligand from binding to a target cellular receptor and preventing activation of the receptor.

Engineering of the extracellular vesicles provided herein extends these capabilities significantly by incorporating sticky binders attaching to extracellular vesicles such as exosomes, further coupled with signaling domains of choice. For example, attachment of sticky binders to exosomes, along with their linked signaling domains, allows for receptor clustering for biological signal induction/agonism and propagation not otherwise possible. In this aspect, the aforementioned design achieves the aim of an engineered extracellular vesicle by inducing the desired biological signaling in a target recipient cell.

Various aspects and embodiments of the compositions and methods are provided herein in detail below.

Engineered Extracellular Vesicle (EV) Compositions

The compositions provided herein comprises at least one extracellular vesicle (also termed artificial synapse or abbrv: EV), wherein the extracellular vesicle comprises at least one fusion polypeptide or a plurality of fusion polypeptides comprising: at least one vesicle targeting domain (e.g., sticky binders); and at least one protein of interest domain or a fragment thereof (also termed signaling domains).

Extracellular vesicles (EVs) are lipid particles that are released from various cell types that function to transfer "cargo" such as nucleic acids and proteins to other cells. EVs are not able to replicate but serve as cell messengers. EV-mediated signals can be transmitted by all the different biomolecule categories—protein, lipids, nucleic acids and sugars—and the unique package of this information provides both protection and the option of simultaneous delivery of multiple different messengers even to sites remote to the vesicular origin. See, e.g., Yañez-Mó M, Siljander P R, Andreu Z, et al. Biological properties of extracellular vesicles and their physiological functions. J Extracell Vesicles. 2015; 4:27066. Published 2015 May 14. doi:10.3402/jev.v4.27066, which is incorporated herein by reference in its entirety. Furthermore, there is an increasing amount of evidence that shows that EVs can modulate a milieu of cellular signaling processes. See, e.g., Yadid et al. *Science Translation Medicine* (2020); Cerqueira de Abreu et al. *Nature Reviews Cardiology* (2020); Zhang W. et al. *Protein J.* (2019); Zha Q B et al. *Tumor Biology*. February 2017; Tan et al. (2016) Recent advances of exosomes in immune modulation and autoimmune diseases, *Autoimmunity*, 49:6, 357-365; Kalluri R, LeBleu V S. et al. The biology, function, and biomedical applications of exosomes. Science. 2020 Feb. 7; 367 (6478); which is incorporated herein by reference in its entirety.

There are various types of extracellular vesicles that are named for their site of origin in a cell, size, and structural and/or functional properties. In some embodiments of any of the aspects provided herein, the extracellular vesicle is an exosome, ectosome, macrovesicle, microparticle, apoptotic body, vesicular organelle, oncosome, exosphere, exomeres, or cell derived nanovesicle (CDN) ((e.g., by genesis via grating or shearing cells), liposomes or the like known by one of ordinary skill in the art. In various embodiments, the extracellular vesicle comprises a phospholipid bilayer with an exterior phospholipid layer and an interior phospholipid layer, wherein the exterior phospholipid layer has an external surface and an internal surface, wherein the interior phospholipid layer has an internal surface and an external surface, and the internal surface of the exterior phospholipid layer faces the internal surface of the interior phospholipid layer, and the phospholipid bilayer encloses an internal space, wherein the external surface of the interior phospholipid layer faces the internal space and wherein the external surface of the exterior phospholipid layer faces an extracellular environment, and the external surface of the inner phospholipid layer is the internal surface of the extracellular vesicle.

In various embodiments, the extracellular vesicles range in size from 30 nanometers (nm) to 300 nm. In various embodiments, the plurality of EVs range in size from about 30 nm to about 150 nm. In various embodiments, the plurality of EVs or artificial synapses includes one or more artificial synapses that are about 10 nm to about 250 nm in diameter, including those about 10 nm to about 15 nm, about 15 nm to about 20 nm, about 20 nm to about 25 nm, about 25 nm to about 30 nm, about 30 nm to about 35 nm, about 35 nm to about 40 nm, about 40 nm to about 50 nm, about 50 nm to about 60 nm3 about 60 nm to about 70 nm, about 70 nm to about 80 nm, about 80 nm to about 90 nm, about 90 nm to about 95 nm, about 95 nm to about 100 nm, about 100 nm to about 105 nm, about 105 nm to about 110 nm, about 110 nm to about 115 nm, about 115 nm to about 120 nm, about 120 nm to about 125 nm, about 125 nm to about 130 nm, about 130 nm to about 135 nm, about 135 nm to about 140 nm, about 140 nm to about 145 nm, about 145 nm to about 150 nm, about 150 to about 200 nm, about 200 nm to about 250 nm, about 250 nm or more.

In some embodiments of any of the aspects provided herein, the EV is an exosome. Exosomes are membrane-bound EVs that are produced in the endosomal compartment of most eukaryotic cells. As used herein, the term "exosome" refers to a species of extracellular vesicle between about 20 nm to about 400 μm in diameter, e.g, about 30 nm-200 nm in diameter by inward invagination of a portion of a membrane of an endosome (for example an early or late endosome), wherein the endosome is within a cell comprising a plasma membrane, and the exosome is released from the cell upon fusion of another portion of the endosome membrane with the plasma membrane. An exosome may refer to a species of extracellular vesicle between 20 nm-400 μM in diameter, more preferably 30 nm-200 nm in diameter, that originates by budding of a portion of a plasma membrane from a cell wherein the budded portion of the plasma membrane is released to the extracellular environment.

The EVs (e.g., exosomes or cell derived vesicles) provided herein may comprise cargo, for example, peptides, proteins, nucleic acids, lipids, metabolites, carbohydrates, biomolecules, small molecules, large molecules, vesicles, organelles, or fragments thereof. Exosome cargo may be located within the internal space of the exosome. EV cargo may be membrane bound spanning one or both layers of the exosome phospholipid bilayer (for example a transmembrane protein). EV cargo may be in contact with the exterior or interior surface of the exosome, for example through a covalent bond or a non-covalent bond. The phospholipid bilayer of the EV or exosome provided herein may comprise one or more transmembrane proteins, wherein a portion of the one or more transmembrane membrane proteins is located within the internal space of the exosome. The phospholipid bilayer of the EV or exosome provided herein may comprise one or more transmembrane proteins, wherein a portion of the one or more transmembrane membrane proteins traverses the EV phospholipid bilayer. The phospholipid bilayer of the EV may comprise one or more transmembrane proteins, wherein the one or more transmembrane membrane proteins comprises a domain on the exterior of the exosome.

In some embodiments of any of the aspects, the extracellular vesicles or exosomes provided herein endogenously express CD81+, CD82+, CD37+, CD63+, CD9+, CD151+, CD105+, or any combination thereof. In various embodiments, the plurality of artificial synapses includes one or more artificial synapses expressing a biomarker. In certain embodiments, the biomarkers are tetraspanins. In other embodiments, the tetraspanins are one or more selected from the group including CD63, CD81, CD82, CD53, CD151, and CD37. In other embodiments, the artificial synapses express one or more lipid raft associated proteins (e.g., glycosylphosphatidylinositol-anchored proteins and flotillin), cholesterol, sphingolipids such as sphingomyelin, and/or hexosylceramides.

In other embodiments, the biological protein is related to exosome formation and packaging of cytosolic proteins, e.g., Hsp70, Hsp90, 14-3-3 epsilon, PKM2, GW182 and AG02. In certain embodiments, the artificial synapses express CD63, HSP70, CD105 or combinations thereof. In other embodiments, the artificial synapses do not express CD9 or CD81, or express neither. For example, plurality of artificial synapses can include one or more artificial synapses that are CD63+, HSP+, CD105+, CD9−, and CD81−.

The EVs provided herein are specifically engineered to express fusion polypeptides that elicit biological signaling via a target cell. In some embodiments, the fusion polypeptide is overexpressed to elicit a biological response on a target cell or target polypeptide. The engineered EV comprises at least one fusion polypeptide and can comprise a plurality of the same or different fusion polypeptides provided herein. The fusion polypeptides provided herein comprise a protein of interest domain, also termed the signaling domain.

The fusion polypeptides provided herein can comprise one or more of a protein of interest domain, such that expression of said fusion polypeptide is permitted and that the number of POI domains does not impede protein expression or folding. Furthermore, the EVs provided herein can express more than one fusion protein (e.g., encoded by multiple different nucleic acid constructs). One of skill in the art can appreciate that an engineered EV can include one or more combinations of different signaling domains and/or vesicle targeting domains, or that one can use a plurality of engineered EVs, each including one or more vesicle targeting domains and one or more signaling domains.

In some embodiments, the EVs provided herein comprise one or more, two or more, three or more, four or more, five or more, six or more, seven or more, eight or more, nine or more, or ten or more fusion proteins. The fusion proteins can be encoded by the same vector or separate vectors. In some embodiments of any of the aspects, the engineered extracellular vesicle comprises at least two POI domains and/or at least two vesicle targeting domains.

In some embodiments, the fusion polypeptide comprises one or more, two or more, three or more, four or more, five or more, or six or more POI domains on the same polypeptide or nucleic acid construct encoding said polypeptide. For example, the fusion polypeptides provided herein can express a fusion polypeptide encoding one or more, two or more, three or more, four or more, five or more, or six or more signaling domains. In another example, the fusion polypeptides provided herein can express a fusion polypeptide encoding an immune checkpoint protein or a protein involved in immune or cell synapse or any combination or fragment thereof.

In some embodiments, the EV comprises one or more, two or more, three or more, four or more, five or more, or six or more fusion polypeptides on the same EV. For example, EVs comprising one or more, two or more, three or more, four or more, five or more, or six or more fusion polypeptides wherein the fusion polypeptides encode a signaling domain. In another example, EVs comprising one or more, two or more, three or more, four or more, five or more, or six or more fusion polypeptides wherein the fusion polypeptides encode for one or more immune checkpoint proteins or proteins involved in immune or cell synapse, or any combination or fragment thereof.

In various embodiments, the signaling domain is a protein or peptide of interest, or a fragment thereof. In various embodiments, the protein of interest (signaling domain) is an immune checkpoint protein. The terms "immune checkpoint protein" or "protein involved in immune or cell synapse" can include but are not limited to adenosine A2A receptor (A2AR), Galectin 9, fibrinogen-like protein 1 (FGL-1), platelet endothelial adhesion factor-1 (PECAM-1), tumor necrosis factor gene 6 protein (TSG-6), Stabilin-1 (STAB-1) also known as Clever-1, Neuropilin 1 (NRP1), Neuropilin 2 (NRP2), semaphorin-3A (SEMA3A), semaphorin-3F (SEMA3F), repulsive guidance molecule B (RGMB) also known as DRG11, T-cell immunoglobulin and mucin domain 3 (TIM-3), T cell immunoreceptor with Ig and ITIM domains (TIGIT), human leukocyte antigen (HLA) class I, HLA class II, high mobility group protein B1 (HMGB1), phosphatidylserine, carcinoembryonic antigen-related cell adhesion molecule 1 (CEACAM-1), T-cell receptor (TCR), Src homology 2 domain-containing protein tyrosine phosphatase 1 (SHP-1), SHP-2, F-Box protein 38 (FBXO38), signaling lymphocytic activation molecule (SLAM)-associated protein (SAP) also known as SH2D1A, B7RP1, indoleamine 2,3-dioxygenase (IDO), NADH oxidase 2 (NOX2), tumor necrosis factor receptor (TNFR) superfamily member 18 (TNFRSF18) (also known as activation inducible TNFR family receptor (AITR), glucocorticoid-induced TNFR related (GITR) protein, and CD357), B7-H4 also known as V-set domain containing T-cell activator inhibitor (VTCN1), B7-H5 (also known as V-domain Ig suppressor of T-cell activation (VISTA), platelet receptor Gi24, and stress induced secreted protein 1 (SISP1), B7-H6 (also known as NCR3LG1), B7-H7 (also known as human endogenous retrovirus-H (HERV-H) long terminal repeat-associating protein 2 (HHLA2), apelin receptor (APLNR), interferon gamma (IFN y) receptor, programmed cell death-1 (PD-1), Protein Wnt-5a (WNT5A), serine/threonine-protein kinase PAK4, interleukin 6 (IL-6), interleukin-10 (IL-10), NKG2 family of C-type lectin receptors (for example NKG2A, B, C, D, E, F and H), ligands of NKG2 family, killer cell immunoglobulin-like receptors, CD-2, cluster of differentiation 4 (CD4), CD8, CD27, CD27 ligand (CD27L, also known as CD70), CD28, CD28H (also known as transmembrane and immunoglobulin domain containing 2 (TMIGD2) and Ig containing and proline-rich receptor-1 (IGPR1)), CD39, CD40, CD44, integrin associated protein (CD47), carcinoembryonic antigen related cell adhesion molecule 1 (CEACAM1 also known as CD66a), CD73, B7-1 (also known as CD80), B7-2 (also known as CD86), CD94, CD96, immunoglobulin superfamily member 2 (IGSF2) also known as CD101, nectin cell adhesion molecule 2 (NECTIN2) (also known as herpesvirus entry mediator B (HVEB), poliovirus receptor related 2 (PRR2, PVRL2 and PVRR2) and CD112), poliovirus receptor related immunoglobulin domain containing protein (PVIRG) also known as CD112R, CD122 (also known as IL5RB and P70-75), OX40 (also known as tumor necrosis factor receptor superfamily member 4 (TNFRSF4) and CD134), OX40 ligand (OX40L), 4-1BB (also known as CD137), CD134 (also known as 4-1BB ligand (4-1BBL) and as tumor necrosis factor ligand superfamily member 9 (TNFSF9) and CD137L), cytotoxic T-lymphocyte-associated protein 4 (CTLA-4) also known as CD152, CD154 (also known as CD40L), poliovirus receptor (PVR) also known as CD155, killer-cell immunoglobulin-like receptors (KIRs) (for example but not limited to CD158 family, CD158a, CD158g, CD158h, KIR2DL1, KIR2DS1, KIRDS3, and KIR2DS5), CD160, signal-regulatory protein alpha (SIRPa) also known as CD172a, OX-2 also known as CD200, CD200R, lymphocyte-activation gene 3 (LAG-3) also known as CD223, CD226, OX40L also known as CD252, herpes virus entry mediator (HVEM) also known as tumor necrosis factor receptor superfamily member 14 (TNFRSF14) and CD270, B- and T-lymphocyte attenuator (BTLA) also known as CD272, programmed cell death ligand-2 (PD-L2) (also known as B7-DC, PDCD1LG2, and CD273), programmed cell death-ligand 1 (PD-L1) (also known as B7-H1 and CD274), B7-H2 (also known as inducible T-cell co-stimulator ligand (ICOSLG), B7RP1, and CD275), B7-H3 also known as CD276, inducible T-cell co-stimulator (ICOS) also known as CD278, programed cell death protein 1 (PD-1) also known as CD279, leukocyte-associated Ig-like receptor-1 (LAIR-1) also known as CD305, collagen family of proteins (for example but not limited to collagen I, collagen II, collagen III alpha 1, collagen IV, collagen XXIII alpha 1, collagen XXV alpha 1), sialic acid-binding immunoglobulin-type lectin 7 (SI-GLEC7) also known as CD328, sialic acid-binding immunoglobulin-type lectin 7 (SIGLEC9) also known as CD329, natural cytotoxicity triggering receptor 3 (NKp30) also known as CD337, or any isoform, fragment, variation thereof, or a ligand to the aforementioned proteins thereof, or the like known by one of ordinary skill in the art. All variants are encompassed by the present invention.

In some embodiments of any of the aspects provided herein, the protein of interest domain (POI domain) comprises a polypeptide or a fragment thereof or a nucleic acid encoding said polypeptide or fragment thereof selected from the group consisting of: Table 1 (below). Non-limiting examples of nucleic acid sequences that encode the POI domains provided herein are also provided in

TABLE 1

| Type I Proteins of Interest Amino Acid Sequence | |
|---|---|
| Protein of Interest | Transcript Sequence (SEQ ID NO:) Amino Acid Sequence (SEQ ID NO:) |
| Human Programmed death-ligand 1 (PD-L1) | >NM_014143.4 *Homo sapiens* CD274 molecule (CD274), transcript variant 1, mRNA AGTTCTGCGCAGCTTCCCGAGGCTCCGCACCAGCCGCGCTTCTGTCCGCCTGCAGGG CATTCCAGAAAGATGAGGATATTTGCTGTCTTTATATTCATGACCTACTGGCATTTG CTGAACGCATTTACTGTCACGGTTCCCAAGGACCTATATGTGGTAGAGTATGGTAGC AATATGACAATTGAATGCAAATTCCCAGTAGAAAAACAATTAGACCTGGCTGCACTA ATTGTCTATTGGGAAATGGAGGATAAGAACATTATTCAATTTGTGCATGGAGAGGAA GACCTGAAGGTTCAGCATAGTAGCTACAGACAGAGGGCCCGGCTGTTGAAGGACCAG CTCTCCCTGGGAAATGCTGCACTTCAGATCACAGATGTGAAATTGCAGGATGCAGGG GTGTACCGCTGCATGATCAGCTATGGTGGTGCCGACTACAAGCGAATTACTGTGAAA GTCAATGCCCCATACAACAAAATCAACCAAAGAATTTTGGTTGTGGATCCAGTCACC TCTGAACATGAACTGACATGTCAGGCTGAGGGCTACCCCAAGGCCGAAGTCATCTGG ACAAGCAGTGACCATCAAGTCCTGAGTGGTAAGACCACCACCACCAATTCCAAGAGA GAGGAGAAGCTTTTCAATGTGACCAGCACACTGAGAATCAACACAACAACTAATGAG ATTTTCTACTGCACTTTTAGGAGATTAGATCCTGAGGAAAACCATACAGCTGAATTG GTCATCCCAGAACTACCTCTGGCACATCCTCCAAATGAAAGGACTCACTTGGTAATT CTGGGAGCCATCTTATTATGCCTTGGTGTAGCACTGACATTCATCTTCCGTTTAAGA AAAGGGAGAATGATGGATGTGAAAAAATGTGGCATCCAAGATACAAACTCAAAGAAG CAAAGTGATACACATTTGGAGGAGACGTAATCCAGCATTGGAACTTCTGATCTTCAA GCAGGGATTCTCAACCTGTGGTTTAGGGGTTCATCGGGGCTGAGCGTGACAAGAGGA |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | AGGAATGGGCCCGTGGGATGCAGGCAATGTGGGACTTAAAAGGCCCAAGCACTGAAA<br>ATGGAACCTGGCGAAAGCAGAGGAGGAGAATGAAGAAAGATGGAGTCAAACAGGGAG<br>CCTGGAGGGAGACCTTGATACTTTCAAATGCCTGAGGGGCTCATCGACGCCTGTGAC<br>AGGGAGAAAGGATACTTCTGAACAAGGAGCCTCCAAGCAAATCATCCATTGCTCATC<br>CTAGGAAGACGGGTTGAGAATCCCTAATTTGAGGGTCAGTTCCTGCAGAAGTGCCCT<br>TTGCCTCCACTCAATGCCTCAATTTGTTTTCTGCATGACTGAGAGTCTCAGTGTTGG<br>AACGGGACAGTATTTATGTATGAGTTTTTCCTATTTATTTTGAGTCTGTGAGGTCTT<br>CTTGTCATGTGAGTGTGGTTGTGAATGATTTCTTTTGAAGATATATTGTAGTAGATG<br>TTACAATTTTGTCGCCAAACTAAACTTGCTGCTTAATGATTTGCTCACATCTAGTAA<br>AACATGGAGTATTTGTAAGGTGCTTGGTCTCCTCTATAACTACAAGTATACATTGGA<br>AGCATAAAGATCAAACCGTTGGTTGCATAGGATGTCACCTTTATTTAACCCATTAAT<br>ACTCTGGTTGACCTAATCTTATTCTCAGACCTCAAGTGTCTGTGCAGTATCTGTTCC<br>ATTTAAATATCAGCTTTACAATTATGTGGTAGCCTACACACATAATCTCATTTCATC<br>GCTGTAACCACCCTGTTGTGATAACCACTATTATTTTACCCATCGTACAGCTGAGGA<br>AGCAAACAGATTAAGTAACTTGCCCAAACCAGTAAATAGCAGACCTCAGACTGCCAC<br>CCACTGTCCTTTTATAATACAATTTACAGCTATATTTTACTTTAAGCAATTCTTTTA<br>TTCAAAAACCATTTATTAAGTGCCCTTGCAATATCAATCGCTGTGCCAGGCATTGAA<br>TCTACAGATGTGAGCAAGACAAAGTACCTGTCCTCAAGGAGCTCATAGTATAATGAG<br>GAGATTAACAAGAAAATGTATTATTACAATTTAGTCCAGTGTCATAGCATAAGGATG<br>ATGCGAGGGGAAAACCCGAGCAGTGTTGCCAAGAGGAGGAAATAGGCCAATGTGGTC<br>TGGGACGGTTGGATATACTTAAACATCTTAATAATCAGAGTAATTTTCATTTACAAA<br>GAGAGGTCGGTACTTAAAATAACCCTGAAAAATAACACTGGAATTCCTTTTCTAGCA<br>TTATATTTATTCCTGATTTGCCTTTGCCATATAATCTAATGCTTGTTTATATAGTGT<br>CTGGTATTGTTTAACAGTTCTGTCTTTTCTATTTAAATGCCACTAAATTTTAAATTC<br>ATACCTTTCCATGATTCAAAATTCAAAAGATCCCATGGGAGATGGTTGGAAAATCTC<br>CACTTCATCCTCCAAGCCATTCAAGTTTCCTTTCCAGAAGCAACTGCTACTGCCTTT<br>CATTCATATGTTCTTCTAAAGATAGTCTACATTTGGAAATGTATGTTAAAAGCACGT<br>ATTTTTAAAATTTTTTTCCTAAATAGTAACACATTGTATGTCTGCTGTGTACTTTGC<br>TATTTTTATTTATTTTAGTGTTTCTTATATAGCAGATGGAATGAATTTGAAGTTCCC<br>AGGGCTGAGGATCCATGCCTTCTTTGTTTCTAAGTTATCTTTCCCATAGCTTTTCAT<br>TATCTTTCATATGATCCAGTATATGTTAAATATGTCCTACATATACATTTAGACAAC<br>CACCATTTGTTAAGTATTTGCTCTAGGACAGAGTTTGGATTTGTTTATGTTTGCTCA<br>AAAGGAGACCCATGGGCTCTCCAGGGTGCACTGAGTCAATCTAGTCCTAAAAAGCAA<br>TCTTATTATTAACTCTGTATGACAGAATCATGTCTGGAACTTTTGTTTTCTGCTTTC<br>TGTCAAGTATAAACTTCACTTTGATGCTGTACTTGCAAAATCACATTTTCTTTCTGG<br>AAATTCCGGCAGTGTACCTTGACTGCTAGCTACCCTGTGCCAGAAAAGCCTCATTCG<br>TTGTGCTTGAACCCTTGAATGCCACCAGCTGTCATCACTACAGCCCTCCTAAGAG<br>GCTTCCTGGAGGTTTCGAGATTCAGATGCCCGGGAGATCCCAGAGTTTCCTTTCCC<br>TCTTGGCCATATTCTGGTGTCAATGACAAGGAGTACCTTGGCTTTGCCACATGTCAA<br>GGCTGAAGAAACAGTGTCTCCAACAGAGCTCCTTGTGTTATCTGTTTGTACATGTGC<br>ATTTGTACAGTAATTGGTGTGACAGTGTTCTTTGTGTGAATTACAGGCAAGAATTGT<br>GGCTGAGCAAGGCACATAGTCTACTCAGTCTATTCCTAAGTCCTAACTCCTCCTTGT<br>GGTGTTGGATTTGTAAGGCACTTTATCCCTTTTGTCTCATGTTTCATCGTAAATGGC<br>ATAGGCAGAGATGATACCTAATTCTGCATTTGATTGTCACTTTTTGTACCTGCATTA<br>ATTTAATAAAATATTCTTATTTATTTTGTTACTTGGTACACCAGCATGTCCATTTTC<br>TTGTTTATTTTGTGTTTAATAAAATGTTCAGTTTAACATCCCA (SEQ ID NO: 1)<br><br>>NP_054862.1 programmed cell death 1 ligand 1 isoform a precursor [Homo sapiens]<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPE<br>LPLAHPPNERTHLVILGAILLCLGVALTFIFRLRKGRMMDVKKCGIQDTNSKKQSDT<br>HLEET (SEQ ID NO: 2) |
| Mouse PD-L1 | >NM_021893.3 Mus musculus CD274 antigen (Cd274), mRNA<br>GAAATCGTGGTCCCCAAGCCTCATGCCAGGCTGCACTTGCACGTCGCGGGCCAGTCT<br>CCTCGCCTGCAGATAGTTCCCAAAACATGAGGATATTTGCTGGCATTATATTCACAG<br>CCTGCTGTCACTTGCTACGGGCGTTTACTATCACGGCTCCAAAGGACTTGTACGTGG<br>TGGAGTATGGCAGCAACGTCACGATGGAGTGCAGATTCCCTGTAGAACGGGAGCTGG<br>ACCTGCTTGCGTTAGTGGTGTACTGGGAAAAGGAAGATGAGCAAGTGATTCAGTTTG<br>TGGCAGGAGAGGAGGACCTTAAGCCTCAGCACAGCAACTTCAGGGGGAGAGCCTCGC<br>TGCCAAAGGACCAGCTTTTGAAGGGAAATGCTGCCCTTCAGATCACAGACGTCAAGC<br>TGCAGGACGCAGGCGTTTACTGCTGCATAATCAGCTACGGTGGTGCGGACTACAAGC<br>GAATCACGCTGAAAGTCAATGCCCCATACCGCAAAATCAACCAGAGAATTTCCGTGG<br>ATCCAGCCACTTCTGAGCATGAACTAATATGTCAGGCCGAGGGTTATCCAGAAGCTG<br>AGGTAATCTGGACAAACAGTGACCACCAACCCGTGAGTGGGAAGAGAAGTGTCACCA<br>CTTCCCGGACAGAGGGGATGCTTCTCAATGTGACCAGCGTCTGAGGGTCAAGGCGCA<br>CAGCGAATGATGTTTCTACTGTACGTTTTGGAGATCACAGCCAGGGCAAAACCACA<br>CAGCGGAGCTGATCATCCCAGAACTGCCTGCAACACATCCTCCACAGAACAGGACTC<br>ACTGGGTGCTTCTGGGATCCATCCTGTTGTTCCTCATTGTAGTGTCCACGGTCCTCC<br>TCTTCTTGAGAAAACAAGTGAGAATGCTAGATGTGGGAGAAATGTGGCGTTGAAGATA<br>CAAGCTCAAAAAACCGAAATGATACACAATTCGAGGAGACGTAAGCAGTGTTGAACC |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | CTCTGATCGTCGATTGGCAGCTTGTGGTCTGTGAAAGAAAGGGCCCATGGGACATGA<br>GTCCAAAGACTCAAGATGGAACCTGAGGGAGAGAACCAAGAAAGTGTTGGGAGAGGA<br>GCCTGGAACAACGGACATTTTTTCCAGGGAGACACTGCTAAGCAAGTTGCCCATCAG<br>TCGTCTTGGGAAATGGATTGAGGGTTCCTGGCTTAGCAGCTGGTCCTTGCACAGTGA<br>CCTTTTCCTCTGCTCAGTGCCGGGATGAGAGATGGAGTCATGAGTGTTGAAGAATAA<br>GTGCCTTCTATTTATTTTGAGTCTGTGTGTTCTCACTTTGGGCATGTAATTATGACT<br>GGTGAATTCTGACGACATGATAGATCTTAAGATGTAGTCACCAAACTCAACTGCTGC<br>TTAGCATCCTCCGTAACTACTGATACAAGCAGGGAACACAGAGGTCACCTGCTTGGT<br>TTGACAGGCTCTTGCTGTCTGACTCAAATAATCTTTATTTTTCAGTCCTCAAGGCTC<br>TTCGATAGCAGTTGTTCTGTATCAGCCTTATAGGTGTCAGGTATAGCACTCAACATC<br>TCATCTCATTACAATAGCAACCCTCATCACCATAGCAACAGCTAACCTCTGTTATCC<br>TCACTTCATAGCCAGGAAGCTGAGCGACTAAGTCACTTGCCCACAGAGTATCAGCTC<br>TCAGATTTCTGTTCTTCAGCCACTGTCCTTTCAGGATAGAATTTGTCGTTAAGAAAT<br>TAATTTAAAAACTGATTATTGAGTAGCATTGTATATCAATCACAACATGCCTTGTGC<br>ACTGTGCTGGCCTCTGAGCATAAAGATGTACGCCGGAGTACCGGTCGGACATGTTTA<br>TGTGTGTTAAATACTCAGAGAAATGTTCATTAACAAGGAGCTTGCATTTTAGAGACA<br>CTGGAAAGTAACTCCAGTTCATTGTCTAGCATTACATTTACCTCATTTGCTATCCTT<br>GCCATACAGTCTCTTGTTCTCCATGAAGTGTCATGAATCTTGTTGAATAGTTCTTTT<br>ATTTTTTAAATGTTTCTATTTAAATGATATTGACATCTGAGGCGATAGCTCAGTTGG<br>TAAAACCCTTTCCTCACAAGTGTGAAACCCTGAGTCTTATCCCTAGAACCCACATAA<br>AAAACAGTTGCGTATGTTTGTGCATGCTTTTGATCCCAGCACTAGGGAGGCAGAGGC<br>AGGCAGATCCTGAGCTCTCATTGACCACCCAGCCTAGCCTACATGGTTAGCTCCAGG<br>CCTACAGGAGCTGGCAGAGCCTGAAAAACGATGCCTAGACACACACACACACACACA<br>CACACACACACACACACACACACACCATGTACTCATAGACCTAAGTGCACCCTCCTA<br>CACATGCACACACATACAATTCAAACACAAATCAACAGGGAATTGTCTCAGAATGGT<br>CCCCAAGACAAAGAAGAAGAAAAACACCAAACCAGCTCTATTCCCTCAGCCTATCCT<br>CTCTACTCCTTCCTAGAAGCAACTACTATTGTTTTTGTATATAAATTTACCCAACGA<br>CAGTTAATATGTAGAATATATATTAAAGTGTCTGTCAATATATATTATCTCTTTCTT<br>TCTTTCTTCCTTTCTTTCTTTCTTTCTTTCTTTCTTTCTTTCTTTCTTTCTTTCTTT<br>CTTCCTTCCTTCCTTCCTTCCTTCCTTCCTTCCTTTCTTTCTTTCTTTCTTTCTTTT<br>TTTCTGTCTATCTGTACCTAAATGGTTGCTCACTATGCATTTTCTGTGCTCTTCGCC<br>CTTTTTATTTAATGTATGGATATTTATGCTGCTTCCAGAATGGATCTAAAGCTCTTT<br>GTTTCTAGGTTTTCTCCCCCATCCTTCTAGGCATCTCTCACACTGTCTAGGCCAGAC<br>ACCATGTCTGCTGCCTGAATCTGTAGACACCATTTATAAAGCACGTACTCACCGAGT<br>TTGTATTTGGCTTGTTCTGTGTCTGATTAAAGGGAGACCATGAGTCCCCAGGGTACA<br>CTGAGTTACCCCAGTACCAAGGGGGAGCCTTGTTTGTGTCTCCATGGCAGAAGCAGG<br>CCTGGAGCCATTTTGGTTTCTTCCTTGACTTCTCTCAAACACAGACGCCTCACTTGC<br>TCATTACAGGTTCTCCTTTGGGAATGTCAGCATTGCTCCTTGACTGCTGGCTGCCCT<br>GGAAGGAGCCCATTAGCTCTGTGTGAGCCCTTGACAGCTACTGCCTCTCCTTACCAC<br>AGGGGCCTCTAAGATACTGTTACCTAGAGGTCTTGAGGATCTGTGTTCTCTGGGGGG<br>AGGAAAGGAGGAGGAACCCAGAACTTTCTTACAGTTTTCCTTGTTCTGTCACATGTC<br>AAGACTGAAGGAACAGGCTGGGCTACGTAGTGAGATCCTGTCTCAAAGGAAAGACGA<br>GCATAGCCGAACCCCCGGTGGAACCCCCTCTGTTACCTGTTCACACAAGCTTATTGA<br>TGAGTCTCATGTTAATGTCTTGTTTGTATGAAGTTTAAGAAAATATCGGTTGGGCA<br>ACACATTCTATTTATTCATTTTATTTGAAATCTTAATGCCATCTCATGGTGTTGGAT<br>TGGTGTGGCACTTTATTCTTTTGTGTTGTGTATAACCATAAATTTTATTTTGCATCA<br>GATTGTCAATGTATTGCATTAATTTAATAAATATTTTTATTTATTAAAAAAAAAAAA<br>AAAAA (SEQ ID NO: 3)<br><br>>NP_068693.1 programmed cell death 1 ligand 1 precursor<br>[*Mus musculus*]<br>MRIFAGIIFTACCHLLRAFTITAPKDLYVVEYGSNVTMECRFPVERELDLLALVVYW<br>EKEDEQVIQFVAGEEDLKPQHSNFRGRASLPKDQLLKGNAALQITDVKLQDAGVYCC<br>IISYGGADYKRITLKVNAPYRKINQRISVDPATSEHELICQAEGYPEAEVIWTNSDH<br>QPVSGKRSVTTSRTEGMLLNVTSSLRVNATANDVFYCTFWRSQPGQNHTAELIIPEL<br>PATHPPQNRTHWVLLGSILLFLIVVSTVLLFLRKQVRMLDVEKCGVEDTSSKNRNDT<br>QFEET (SEQ ID NO: 4) |
| Human PD-L2 | >NM_025239.4 *Homo sapiens* programmed cell death 1 ligand<br>2 (PCD1LG2), mRNA<br>ACTCTCATGTTACGGCAAACCTTAAGCTGAATGAACAACTTTTCTTCTCTTGAATAT<br>ATCTTAACGCCAAATTTTGAGTGCTTTTTTGTTACCCATCCTCATATGTCCCAGCTA<br>GAAAGAATCCTGGGTTGGAGCTACTGCATGTTGATTGTTTTGTTTTTCCTTTTGGCT<br>GTTCATTTTGGTGGCTACTATAAGGAAATCTAACACAAACAGCAACTGTTTTTTGTT<br>GTTTACTTTGCATCTTTACTTGTGGAGCTGTGGCAAGTCCTCATATCAAATACAGA<br>ACATGATCTTCCTCCTGCTAATGTTGAGCCTGGAATTGCAGCTTCACCAGATAGCAG<br>CTTTATTCACAGTGACAGTCCCTAAGGAACTGTACATAATAGAGCATGGCAGCAATG<br>TGACCCTGGAATGCAACTTTGACACTGGAAGTCATGTGAACCTTGGAGCAATAACAG<br>CCAGTTTGCAAAAGGTGGAAAATGATACATCCCCACACCGTGAAAGAGCCACTTTGC<br>TGGAGGAGCAGCTGCCCCTAGGGAAGGCCTCGTTCCACATACCTCAAGTCCAAGTGA<br>GGGACGAAGGACAGTACCAATGCATAATCATCTATGGGGTCGCCTGGGACTACAAGT<br>ACCTGACTCTGAAAGTCAAAGCTTCCTACAGGAAAATAAACACTCACATCCTAAAGG<br>TTCCAGAAACAGATGAGGTAGAGCTCACCTGCCAGGCTACAGGTTATCCTCTGGCAG<br>AAGTATCCTGGCCAAACGTCAGCGTTCCTGCCAACACCAGCCACTCCAGGACCCCTG<br>AAGGCCTCTACCAGGTCACCAGTGTTCTGCGCCTAAAGCCACCCCCTGGCAGAAACT |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | TCAGCTGTGTGTTCTGGAATACTCACGTGAGGGAACTTACTTTGGCCAGCATTGACC<br>TTCAAAGTCAGATGGAACCCAGGACCCATCCAACTTGGCTGCTTCACATTTTCATCC<br>CCTTCTGCATCATTGCTTTCATTTTCATAGCCACAGTGATAGCCCTAAGAAAACAAC<br>TCTGTCAAAAGCTGTATTCTTCAAAAGACACAACAAAAAGACCTGTCACCACAACAA<br>AGAGGGAAGTGAACAGTGCTATCTGAACCTGTGGTCTTGGGAGCCAGGGTGACCTGA<br>TATGACATCTAAAGAAGCTTCTGGACTCTGAACAAGAATTCGGTGGCCTGCAGAGCT<br>TGCCATTTGCACTTTTCAAATGCCTTTGGATGACCCAGCACTTTAATCTGAAACCTG<br>CAACAAGACTAGCCAACACCTGGCCATGAAACTTGCCCCTTCACTGATCTGGACTCA<br>CCTCTGGAGCCTATGGCTTTAAGCAAGCACTACTGCACTTTACAGAATTACCCCACT<br>GGATCCTGGACCCACAGAATTCCTTCAGGATCCTTCTTGCTGCCAGACTGAAAGCAA<br>AAGGAATTATTTCCCCTCAAGTTTTCTAAGTGATTTCCAAAAGCAGAGGTGTGTGGA<br>AATTTCCAGTAACAGAAACAGATGGGTTGCCAATAGAGTTATTTTTTATCTATAGCT<br>TCCTCTGGGTACTAGAAGAGGCTATTGAGACTATGAGCTCACAGACAGGGCTTCGCA<br>CAAACTCAAATCATAATTGACATGTTTATGGATTACTGGAATCTTGATAGCATAAT<br>GAAGTTGTTCTAATTAACAGAGAGCATTTAAATATACACTAAGTGCACAAATTGTGG<br>AGTAAAGTCATCAAGCTCTGTTTTTGAGGTCTAAGTCACAAAGCATTTGTTTTAACC<br>TGTAATGGCACCATGTTTAATGGTGGTTTTTTTTTGAACTACATCTTTCCTTTAAA<br>AATTATTGGTTTCTTTTTATTTGTTTTTACCTTAGAAATCAATTATATACAGTCAAA<br>AATATTTGATATGCTCATACGTTGTATCTGCAGCAATTTCAGATAAGTAGCTAAAAT<br>GGCCAAAGCCCCAAACTAAGCCTCCTTTTCTGGCCCTCAATATGACTTTAAATTTGA<br>CTTTTCAGTGCCTCAGTTTGCACATCTGTAATACAGCAATGCTAAGTAGTCAAGGCC<br>TTTGATAATTGGCACTATGGAAATCCTGCAAGATCCCACTACATATGTGTGGAGCAG<br>AAGGGTAACTCGGCTACAGTAACAGCTTAATTTTGTTAAATTTGTTCTTTATACTGG<br>AGCCATGAAGCTCAGAGCATTAGCTGACCCTTGAACTATTCAAATGGGCACATTAGC<br>TAGTATAACAGACTTACATAGGTGGGCCTAAAGCAAGCTCCTTAACTGAGCAAAATT<br>TGGGGCTTATGAGAATGAAAGGGTGTGAAATTGACTAACAGACAAATCATACATCTC<br>AGTTTCTCAATTCTCATGTAAATCAGAGAATGCCTTTAAAGAATAAAACTCAATTGT<br>TATTCTTCAACGTTCTTTATATATTCTACTTTTGGGTA (SEQ ID NO: 5)<br><br>>NP_079515.2 programmed cell death 1 ligand 2 precursor<br>[Homo sapiens]<br>MIFLLLMLSLELQLHQIAALFTVTVPKELYIIEHGSNVTLECNFDTGSHVNLGAITA<br>SLQKVENDTSPHRERATLLEEQLPLGKASFHIPQVQVRDEGQYQCIIIYGVAWDYKY<br>LTLKVKASYRKINTHILKVPETDEVELTCQATGYPLAEVSWPNVSVPANTSHSRTPE<br>GLYQVTSVLRLKPPPGRNFSCVFWNTHVRELTLASIDLQSQMEPRTHPTWLLHIFIP<br>FCIIAFIFIATVIALRKQLCQKLYSSKDTTKRPVTTTKREVNSAI (SEQ ID NO: 6) |
| Mouse PD-L2 | >NM_021396.2 Mus musculus programmed cell death 1 ligand<br>2 (Pdcd1lg2), mRNA<br>GACCACACATCATTTTTGTTCCCTTTGTTGGATATATCCTAATGTCAAATGTGGCATAT<br>CTTTGTTGTCTCCTTCTGTCTCCCAACTAGAGAGAACACACTTACGGCTCCTGTCCC<br>GGGCAGGTTTGGTTGTCGGTGTGATTGGCTTCCAGGGAACCTGATACAAGGAGCAAC<br>TGTGTGCTGCCTTTTCTGTGTCTTTGCTTGAGGAGCTGTGCTGGGTGCTGATATTGA<br>CACAGACCATGCTGCTCCTGCTGCCGATACTGAACCTGAGCTTACAACTTCATCCTG<br>TAGCAGCTTTATTCACCGTGACAGCCCCTAAAGAAGTGTACACCGTAGACGTCGGCA<br>GCAGTGTGAGCCTGGAGTGCGATTTTGACCGCAGAGAATGCACTGAACTGGAAGGGA<br>TAAGAGCCAGTTTGCAGAAGGTAGAAAATGATACGTCTCTGCAAAGTGAAAGAGCCA<br>CCCTGCTGGAGGAGCAGCTGCCCCTGGGAAAGGCTTTGTTCCACATCCCTAGTGTCC<br>AAGTGAGAGATTCCGGGCAGTACCGTTGCCTGGTCATCTGCGGGGCCGCCTGGGACT<br>ACAAGTACCTGACGGTGAAAGTCAAAGCTTCTTACATGAGGATAGACACTAGGATCC<br>TGGAGGTTCCAGGTACAGGGGAGGTGCAGCTTACCTGCCAGGCTAGAGGTTATCCCC<br>TAGCAGAAGTGTCCTGGCAAAATGTCAGTGTTCCTGCCAACACCAGCCACATCAGGA<br>CCCCCGAAGGCCTCTACCAGGTCACCAGTGTTCTGCGCCTCAAGCCTCAGCCTAGCA<br>GAAACTTCAGCTGCATGTTCTGGAATGCTCACATGAAGGAGCTGACTTCAGCCATCA<br>TTGACCCTCTGAGTCGGATGGAACCCAAAGTCCCCAGAACGTGGCCACTTCATGTTT<br>TCATCCCGGCCTGCACCATCGCTTTGATCTTCCTGGCCATAGTGATAATCCAGAGAA<br>AGAGGATCTAGGGGAAGCTGTATTACGGAAGAAGATCTGGACCTGCGGTCTTGGGAG<br>TTGGAAGGATCTGATGGGAAACCCTCAAGAGACTTCTGGACTCAAAGTGAGAATCTT<br>GCAGGACCTGCCATTTGCACTTTTGAACCCTTTGGACGGTGACCCAGGGCTCCGAAG<br>AGGAGCTTGTAAGACTGACAATCTTCCCTCTGTCTCAAGACTCTCTGAACAGCAAGA<br>CCCCAATGGCACTTTAGACTTACCCCTGGGATCCTGGACCCCAGTGAGGGCCTAAGG<br>CTCCTAATGACTTTCAGGGTGAGAACAAAAGGAATTGCTCTCCGCCCCACCCCCACC<br>TCCTGCTTTCCGCAGGGAGACATGGAAATTCCCAGTTACTAAAATAGATTGTCAATA<br>GAGTTATTTATAGCCCTCATTTCCTCCGGGGACTTGGAAGCTTCAGACAGGGTTTTT<br>CATAAACAAAGTCATAACTGATGTGTTTTACAGCATCCTAGAATCCTGGCAGCCTCT<br>GAAGTTCTAATTAACTGGAAGCATTTAAGCAACACGTTAAGTACCCCCACTGTGGTA<br>TTTGTTTCTACTTTTCTGTTTTTAAAGTGTGAGTCACAAGGTAATTGTTGTAACCTG<br>TGATATCACTGTTTCTTGTGTCTCTTCTTTCAACTACATCTTTTAAAACAAAACGGT<br>GTGGGGTTTGGTTGTTTGGTGGTAGTGGTAGTGTTTCTCAGTGGTATCTCCTTAAG<br>AAAAAAAATCATCATGCCAGTGAATTGTTTCTTCAGCCATTTCAGATGGGAAGCTGG<br>AATAGCCTGTCCCCAAGCTAAGCCTTCTTCCCTAGCTTTCTGCGTGATTTTACATT<br>GAGCATTCCTGTTGCTTTGTTTCTATAACTGTAATGTGGTGATGTCATTGTTAGGGC<br>ACTTGAGGGTGGCGTTCTGGAAGTCCTTTCAGGTTAGTGTTTGGGGGCAGGGTTGC<br>TCAGAATACATAAAGGTGCTAACTTAAACTGCAGCCATGGAGCTCAGTGAATTCACT |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | AACCTTCGGGCTGTCCAAATGTGCACATTAGCTACTGTGACCCCTGTAGGTTAGGGA<br>GCCTGAAGCCAGCTCTTTACCTGGTGTTTAGACTCAGCAGAATTTGGAGTCAATGGG<br>ACCAAATGGTTGTGAAATTAAGATTTGAAGTGTGCATCTTATTTTATCACCATCTGC<br>CCAACAAAACTTCAGAAAATGCCTTTGAAGCACAAAAATGTAATCGTTTATGTGAAA<br>TCTCTGAGTTGCATTTAGATGCCCATTGCAGCAAGGTGGCTCTCTCACAGATTCCAC<br>ACCTTAGCCTAAGATACCAGACAGCAGGACAGAGAGAAAAGTCCTTCCTGGTGTGCA<br>AACTTCCTTACACTGGACCTCGCCTCTCAGGTGTGTGATTGGTAGGCCAAATCCCGA<br>TAGCCAATCGGTGTTGGGTGCTTTGTCTGCTCTACTGGGAGTCCAGTGGTACAATGG<br>ATTCTGGCAAAATGCTGCCATCTTGGCCCTCGCTGGGCTGCTTTCTAGGATATTCAT<br>AGAGAAAGGGCCGTCCAGATCCAGTATCCTAAAATCCTGAGAGGAGAATATAAGTTA<br>GTGTGTCTCACTATAACTATCTCTATGATCGGTCACATTACTATCTAACAGTTACCA<br>AATACTATATGCCTAATACTGGTAAGCATTTTATACACACCATTGGATTGAATCCTC<br>TCAAAATCCTCAAAAAGGAAGTTATTAATACCTCCATAGGCAAGGAGCCCAGAACCC<br>AGAGAGGTCAGGCAGTCTAGTTATAGATGCCTGCTTTGTTTAGAAGTGAACAAGAGC<br>ATCAAATTATTAATGTGCCCTGGTTATTAATGCGCCCTGGTTACCTGCTGGATGGAA<br>CATCAAGGTGGACTTTTGGCAGTTGCATACACCCAGAGGTATTTTGGCTATTCACGG<br>ATTAATTTCACACGAAGTGTTTCAGAGACATGTGTAGGGGAAGTCCGGGTTCAGGGG<br>GCCTAAGATTCAAACTCTAGCTTAGCTACGTCTGACCTCCCTAAGCACTAACTTACT<br>ATCAAAGAATGAGCAGTAAAAGAATGGTGTTTACTGCCTGCCTTTATCAGGCAGTG<br>AACGTGCAGCGGGCAACGAATGCTTGATAAGTGTGTGTCAGTGTGAAGTCCCATGTA<br>CCAGCCGCTGTCCCCACTGCAAAAGCAGCAGAGCGCTCAGACATCATCAGCTGATTT<br>ACCAGCAGCAGATTTCTTCTTCTAGTCCCATCCCTGAAGAAGCTTCCAGCCTAGGTA<br>CATTGCATGGGCTTTGTGCTCCAGGAGTTCCTACACAGCCCTCAACTTCAACACAGG<br>CAAAGTGCTTACTGATCCTCATGTATCTTACAGGGTCCCCTCTACCCACAATACCTC<br>ATTGCTGGAACTTCAAATCTTCCTGAATAAAAGCTTGCCCGTGGTTTAATTA (SEQ ID NO: 7)<br><br>>NP_067371.1 programmed cell death 1 ligand 2 precursor [*Mus musculus*]<br>MLLLLPILNLSLQLHPVAALFTVTAPKEVYTVDVGSSVSLECDFDRRECTELEGIRA<br>SLQKVENDTSLQSERATLLEEQLPLGKALFHIPSVQVRDSGQYRCLVICGAAWDYKY<br>LTVKVKASYMRIDTRILEVPGTGEVQLTCQARGYPLAEVSWQNVSVPANTSHIRTPE<br>GLYQVTSVLRLKPQPSRNFSCMFWNAHMKELTSAIIDPLSRMEPKVPRTWPLHVFIP<br>ACTIALIFLAIVIIQRKRI (SEQ ID NO: 8) |
| Human CTLA-4 (CD152) | >NM_005214.5 *Homo sapiens* cytotoxic T-lymphocyte associated protein 4 (CTLA4), transcript variant 1, mRNA<br>GCTTTCTATTCAAGTGCCTTCTGTGTGTGCACATGTGTAATACATATCTGGGATCAA<br>AGCTATCTATATAAAGTCCTTGATTCTGTGTGGGTTCAAACACATTTCAAAGCTTCA<br>GGATCCTGAAAGGTTTTGCTCTACTTCCTGAAGACCTGAACACCGCTCCCATAAAGC<br>CATGGCTTGCCTTGGATTTCAGCGGCACAAGGCTCAGCTGAACCTGGCTACCAGGAC<br>CTGGCCCTGCACTCTCCTGTTTTTTCTTCTCTTCATCCCTGTCTTCTGCAAAGCAAT<br>GCACGTGGCCCAGCCTGCTGTGGTACTGGCCAGCAGCCGAGGCATCGCCAGCTTTGT<br>GTGTGAGTATGCATCTCCAGGCAAAGCCACTGAGGTCCGGGTGACAGTGCTTCGGCA<br>GGCTGACAGCCAGGTGACTGAAGTCTGTGCGGCAACCTACATGATGGGGAATGAGTT<br>GACCTTCCTAGATGATTCCATCTGCACGGGCACCTCCAGTGGAAATCAAGTGAACCT<br>CACTATCCAAGGACTGAGGGCCATGGACACGGGACTCTACATCTGCAAGGTGGAGCT<br>CATGTACCCACCGCCATACTACCTGGGCATAGGCAACGGAACCCAGATTTATGTAAT<br>TGATCCAGAACCGTGCCCAGATTCTGACTTCCTCCTCTGGATCCTTGCAGCAGTTAG<br>TTCGGGGTTGTTTTTTTATAGCTTTCTCCTCACAGCTGTTTCTTTGAGCAAAATGCT<br>AAAGAAAAGAAGCCCTCTTACAACAGGGGTCTATGTGAAAATGCCCCAACAGAGCC<br>AGAATGTGAAAAGCAATTTCAGCCTTATTTTATTCCCATCAATTGAGAAACCATTAT<br>GAAGAAGAGAGTCCATATTTCAATTTCCAAGAGCTGAGGCAATTCTAACTTTTTTGC<br>TATCCAGCTATTTTTATTTGTTTGTGCATTTGGGGGGAATTCATCTCTCTTTAATAT<br>AAAGTTGGATGCGGAACCCAAATTACGTGTACTACAATTTAAAGCAAAGGAGTAGAA<br>AGACAGAGCTGGGATGTTTCTGTCACATCAGCTCCACTTTCAGTGAAAGCATCACTT<br>GGGATTAATATGGGGATGCAGCATTATGATGTGGGTCAAGGAATTAAGTTAGGGAAT<br>GGCACAGCCCAAAGAAGGAAAAGGCAGGGAGCGAGGGAGAAGACTATATTGTACACA<br>CCTTATATTTACGTATGAGACGTTTATAGCCGAAATGATCTTTTCAAGTTAAATTTT<br>ATGCCTTTTATTTCTTAAACAAATGTATGATTACATCAAGGCTTCAAAAATACTCAC<br>ATGGCTATGTTTAGCCAGTGATGCTAAAGGTTGTATTGCATATATACATATATATA<br>TATATATATATATATATATATATATATATATATATATATTTAATTTGA<br>TAGTATTGTGCATAGAGCCACGTATGTTTTGTGTATTTGTTAATGGTTTGAATATA<br>AACACTATATGGCAGTGTCTTTCCACCTTGGGTCCCAGGGAAGTTTTGTGGAGGAGC<br>TCAGGACACTAATACACCAGGTAGAACACAAGGTCATTTGCTAACTAGCTTGGAAAC<br>TGGATGAGGTCATAGCAGTGCTTGATTGCGTGGAATTGTGCTGAGTTGGTGTTGACA<br>TGTGCTTTGGGGCTTTTACACCAGTTCCTTTCAATGGTTTGCAAGGAAGCCACAGCT<br>GGTGGTATCTGAGTTGACTTGACAGAACACTGTCTTGAAGACAATGGCTTACTCCAG<br>GAGACCCACAGGTATGACCTTCTAGGAAGCTCCAGTTCGATGGGCCCAATTCTTACA<br>AACATGTGGTTAATGCCATGGACAGAAGAAGGCAGCAGGTGGCAGAATGGGGTGCAT<br>GAAGGTTTCTGAAAATTAACACTGCTTGTGTTTTAACTCAATATTTTCCATGAAAA<br>TGCAACAACATGTATAATATTTTTAATTAAATAAAAATCTGTGGTGGTCGTTTTCCG<br>GA (SEQ ID NO: 9) |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | >NP_005205.2 cytotoxic T-lymphocyte protein 4 isoform CTLA4-TM precursor [Homo sapiens]<br>MACLGFQRHKAQLNLATRTWPCTLLFFLLFIPVFCKAMHVAQPAVVLASSRGIASFV<br>CEYASPGKATEVRVTVLRQADSQVTEVCAATYMMGNELTFLDDSICTGTSSGNQVNL<br>TIQGLRAMDTGLYICKVELMYPPPYYLGIGNGTQIYVIDPEPCPDSDFLLWILAAVS<br>SGLFFYSFLLTAVSLSKMLKKRSPLTTGVYVKMPPTEPECEKQFQPYFIPIN (SEQ ID NO: 10) |
| Mouse CTLA-4 (CD152) | >NM_009843.4 Mus musculus cytotoxic T-lymphocyte-associated protein 4 (Ctla4), transcript variant 1, mRNA<br>CTACACATATGTAGCACGTACCTTGGATCAAAGCTGTCTATATAAAGTCCCCGAGTC<br>TGTGTGGGTTCAAACACATCTCAAGGCTTCTGGATCCTGTTGGGTTTTACTCTGCTC<br>CCTGAGGACCTCAGCACATTTGCCCCCCAGCCATGGCTTGTCTTGGACTCCGGAGGT<br>ACAAAGCTCAACTGCAGCTGCCTTCTAGGACTTGGCCTTTTGTAGCCCTGCTCACTC<br>TTCTTTTCATCCCAGTCTTCTCTGAAGCCATACAGGTGACCCAACCTTCAGTGGTGT<br>TGGCTAGCAGCCATGGTGTCGCCAGCTTTCCATGTGAATATTCACCATCACACAACA<br>CTGATGAGGTCCGGGTGACTGTGCTGCGGCAGACAAATGACCAAATGACTGAGGTCT<br>GTGCCACGACATTCACAGAGAAGAATACAGTGGGCTTCCTAGATTACCCCTTCTGCA<br>GTGGTACCTTTAATGAAAGCAGAGTGAACCTCACCATCCAAGGACTGAGAGCTGTTG<br>ACACGGGACTGTACCTCTGCAAGGTGGAACTCATGTACCCACCGCCATACTTTGTGG<br>GCATGGGCAACGGGACGCAGATTTATGTCATTGATCCAGAACCATGCCCGGATTCTG<br>ACTTCCTCCTTTGGATCCTTGTCGCAGTTAGCTTGGGGTTGTTTTTTACAGTTTCC<br>TGGTCACTGCTGTTTCTTTGAGCAAGATGCTAAAGAAAAGAAGTCCTCTTACAACAG<br>GGGTCTATGTGAAAATGCCCCAACAGAGCCAGAATGTGAAAAGCAATTTCAGCCTT<br>ATTTTATTCCCATCAACTGAAAGGCCGTTTATGAAGAAGAAGGAGCATACTTCAGTC<br>TCTAAAAGCTGAGGCAATTTCAACTTTCCTTTTCTCTCCAGCTATTTTTACCTGTTT<br>GTATATTTTAAGGAGAGTATGCCTCTCTTTAATAGAAAGCTGGATGCAAAATTCCAA<br>TTAAGCATACTACAATTTAAAGCTAAGGAGCATGAACAGAGAGCTGGGATATTTCTG<br>TTGTGTCAGAACCATTTTACTAAAAGCATCACTTGGAAGCAGCATAAGGATATAGCA<br>TTATGGTGTGGGGTCAAGGGAACATTAGGGAATGGCACAGCCCAAAGAAAGGAAGGG<br>GGTGAAGGAAGAGATTATATTGTACACATCTTGTATTTACCTGAGAGATGTTTATGA<br>CTTAAATAATTTTTAAATTTTTCATGCTGTTATTTTCTTTAACAATGTATAATTACA<br>CGAAGGTTTAAACATTTATTCACAGAGCTATGTGACATAGCCAGTGGTTCCAAAGGT<br>TGTAGTGTTCCAAGATGTATTTTTAAGTAATATTGTACATGGGTGTTTCATGTGCTG<br>TTGTGTATTTGCTGGTGGTTTGAATATAAACACTATGTATCAGTGTCGTCCCACAGT<br>GGGTCCTGGGGAGGTTTGGCTGGGGAGCTTAGGACACTAATCCATCAGGTTGGACTC<br>GAGGTCCTGCACCAACTGGCTTGGAAACTAGATGAGGCTGTCACAGGGCTCAGTTGC<br>ATAAACCGATGGTGATGGAGTGTAAACTGGGTCTTTACACTCATTTTATTTTTTGTT<br>TCTGCTTTTGTTTTCTTCAATGATTTGCAAGGAAACCAAAAGCTGGCAGTGTTTGTA<br>TGAACCTGACAGAACACTGTCTTCAAGGAAATGCCTCATTCCTGAGACCAGTAGGTT<br>TGTTTTTTTAGGAAGTTCCAATACTAGGACCCCCTACAAGTACTATGGCTCCTCGAA<br>AACACAAAGTTAATGCCACAGGAAGCAGCAGATGGTAGGATGGGATGCACAAGAGTT<br>CCTGAAAACTAACACTGTTAGTGTTTTTTTTTAACTCAATATTTTCCATGAAAATG<br>CAACCACATGTATAATATTTTTAATTAAATAAAAGTTTCTTGTGATTGTTTT (SEQ ID NO: 11) |
| | >NP_033973.2 cytotoxic T-lymphocyte protein 4 isoform 1 precursor [Mus musculus]<br>MACLGLRRYKAQLQLPSRTWPFVALLTLLFIPVFSEAIQVTQPSVVLASSHGVASFP<br>CEYSPSHNTDEVRVTVLRQTNDQMTEVCATTFTEKNTVGFLDYPFCSGTFNESRVNL<br>TIQGLRAVDTGLYLCKVELMYPPPYFVGMGNGTQIYVIDPEPCPDSDFLLWILVAVS<br>LGLFFYSFLVTAVSLSKMLKKRSPLTTGVYVKMPPTEPECEKQFQPYFIPIN (SEQ ID NO: 12) |
| Human 4-1BBL (CD137L) | >NM_003811.4 Homo sapiens TNF superfamily member 9 (TNFSF9), mRNA<br>AGTCTCTCGTCATGGAATACGCCTCTGACGCTTCACTGGACCCCGAAGCCCGTGGC<br>CTCCCGCGCCCCGCGCTCGCGCCTGCCGCGTACTGCCTTGGGCCCTGGTCGCGGGGC<br>TGCTGCTGCTGCTGCTCGCTGCCGCCTGCGCCGTCTTCCTCGCCTGCCCCTGGG<br>CCGTGTCCGGGGCTCGCGCCTCGCCCGGCTCCGCGGCCAGCCCGAGACTCCGCGAGG<br>GTCCCGAGCTTTCGCCCGACGATCCCGCCGGCCTCTTGGACCTGCGGCAGGGCATGT<br>TTGCGCAGCTGGTGGCCCAAAATGTTCTGCTGATCGATGGGCCCCTGAGCTGGTACA<br>GTGACCCAGGCCTGGCAGGCGTGTCCCTGACGGGGGGCCTGAGCTACAAAGAGGACA<br>CGAAGGAGCTGGTGGTGGCCAAGGCTGGAGTCTACTATGTCTTCTTTCAACTAGAGC<br>TGCGGCGCGTGGTGGCCGGCGAGGGCTCAGGCTCCGTTTCACTTGCGCTGCACCTGC<br>AGCCACTGCGCTCTGCTGCTGGGGCCGCCGCCCTGGCTTTGACCGTGGACCTGCCAC<br>CCGCCTCCTCCGAGGCTCGGAACTCGGCCTTCGGTTTCCAGGGCCGCTTGCTGCACC<br>TGAGTGCCGGCCAGCGCCTGGGCGTCCATCTTCACACTGAGGCCAGGGCACGCCATG<br>CCTGGCAGCTTACCCAGGGCGCCACAGTCTTGGGACTCTTCCGGGTGACCCCCGAAA<br>TCCCAGCCGGACTCCCTTCACCGAGGTCGGAATAACGTCCAGCCTGGGTGCAGCCCA<br>CCTGGACAGAGTCCGAATCCTACTCCATCCTTCATGGAGACCCCTGGTGCTGGGTCC<br>CTGCTGCTTTCTCTACCTCAAGGGGCTTGGCAGGGGTCCCTGCTGCTGACCTCCCCT<br>TGAGGACCCTCCTCACCCACTCCTTCCCCAAGTTGGACCTTGATATTTATTCTGAGC<br>CTGAGCTCAGATAATATATTATATATATTATATATATATATATATTTCTATTTAAAG |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | AGGATCCTGAGTTTGTGAATGGACTTTTTTAGAGGAGTTGTTTTGGGGGGGGGGGG<br>TCTTCGACATTGCCGAGGCTGGTCTTGAACTCCTGGACTTAGACGATCCTCCTGCCT<br>CAGCCTCCCAAGCAACTGGGATTCATCCTTTCTATTAATTCATTGTACTTATTTGCT<br>TATTTGTGTGTATTGAGCATCTGTAATGTGCCAGCATTGTGCCCAGGCTAGGGGGCT<br>ATAGAAACATCTAGAAATAGACTGAAAGAAAATCTGAGTTATGGTAATACGTGAGGA<br>ATTTAAAGACTCATCCCCAGCCTCCACCTCCTGTGTGATACTTGGGGGCTAGCTTTT<br>TTCTTTCTTTCTTTTTTTGAGATGGTCTTGTTCTGTCAACCAGGCTAGAATGCAGC<br>GGTGCAATCATGAGTCAATGCAGCCTCCAGCCTCGACCTCCCGAGGCTCAGGTGATC<br>CTCCCATCTCAGCCTCTCGAGTAGCTGGGACCACAGTTGTGTGCCACCACACTTGGC<br>TAACTTTTTAATTTTTTTGCGGAGACGGTATTGCTATGTTGCCAAGGTTGTTTACAT<br>GCCAGTACAATTTATAATAAACACTCATTTTTCCTCCC (SEQ ID NO: 13)<br><br>>NP_003802.1 tumor necrosis factor ligand superfamily<br>member 9 [Homo sapiens]<br>MEYASDASLDPEAPWPPAPRARACRVLPWALVAGLLLLLLLAAACAVFLACPWAVSG<br>ARASPGSAASPRLREGPELSPDDPAGLLDLRQGMFAQLVAQNVLLIDGPLSWYSDPG<br>LAGVSLTGGLSYKEDTKELVVAKAGVYYVFFQLELRRVVAGEGSGSVSLALHLQPLR<br>SAAGAAALALTVDLPPASSEARNSAFGFQGRLLHLSAGQRLGVHLHTEARARHAWQL<br>TQGATVLGLFRVTPEIPAGLPSPRSE (SEQ ID NO: 14) |
| Mouse 4-1BBL<br>(CD137L) | >NM_009404.3 Mus musculus tumor necrosis factor (ligand)<br>superfamily, member 9 (Tnfsf9), mRNA<br>ATAAAGCACGGGCACTGGCGGGAGACGTGCACTGACCGACCGTGGTAATGGACCAGC<br>ACACACTTGATGTGGAGGATACCGCGGATGCCAGACATCCAGCAGGTACTTCGTGCC<br>CCTCGGATGCGGCGCTCCTCAGAGATACCGGGCTCCTCGCGGACGCTGCGCTCCTCT<br>CAGATACTGTGCGCCCCACAAATGCCGCGCTCCCACGGATGCTGCCTACCCTGCGG<br>TTAATGTTCGGGATCGCGAGGCCGCGTGGCCGCCTGCACTGAACTTCTGTTCCCGCC<br>ACCCAAAGCTCTATGGCCTAGTCGCTTTGGTTTTGCTGCTTCTGATCGCCGGCCTGTG<br>TTCCTATCTTCACCCGCACCGAGCCTCGGCCAGCGCTCACAATACCACCTCGCCCA<br>ACCTGGGTACCCGAGAGAATAATGCAGACCAGGTCACCCCTGTTTCCCACATTGGCT<br>GCCCCAACACTACACAACAGGGCTCTCCTGTGTTCGCCAAGCTACTGGCTAAAAACC<br>AAGCATCGTTGTGCAATACAACTCTGAACTGGCACAGCCAAGATGGAGCTGGGAGCT<br>CATACCTATCTCAAGGTCTGAGGTACGAAGAAGACAAAAAGGAGTTGGTGGTAGACA<br>GTCCCGGGCTCTACTACGTATTTTTGGAACTGAAGCTCAGTCCAACATTCACAAACA<br>CAGGCCACAAGGTGCAGGGCTGGGTCTCTCTTGTTTTGCAAGCAAAGCCTCAGGTAG<br>ATGACTTTGACAACTTGGCCCTGACAGTGGAACTGTTCCCTTGCTCCATGGAGAACA<br>AGTTAGTGGACCGTTCCTGGAGTCAACTGTTGCTCCTGAAGGCTGGCCACCGCCTCA<br>GTGTGGGTCTGAGGGCTTATCTGCATGGAGCCCAGGATGCATACAGAGACTGGGAGC<br>TGTCTTATCCCAACACCACCAGCTTTGGACTCTTTCTTGTGAAACCCGACAACCCAT<br>GGGAATGAGAACTATCCTTCTTGTGACTCCTAGTTGCTAAGTCCTCAAGCTGCTATG<br>TTTTATGGGGTCTGAGCAGGGGTCCCTTCCATGACTTTCTCTTGTCTTTAACTGGAC<br>TTGGTATTTATTCTGAGCATAGCTCAGACAAGACTTTATATAATTCACTAGATAGCA<br>TTAGTAAACTGCTGGGCAGCTGCTAGATAAAAAAAAATTTCTAAATCAAAGTTTATA<br>TTTATATTAATATATAAAAATAAATGTGTTTGT (SEQ ID NO: 15)<br><br>>NP_033430.1 tumor necrosis factor ligand superfamily<br>member 9 [Mus musculus]<br>MDQHTLDVEDTADARHPAGTSCPSDAALLRDTGLLADAALLSDTVRPTNAALPTDAA<br>YPAVNVRDREAAWPPALNFCSRHPKLYGLVALVLLLLIAACVPIFTRTEPRPALTIT<br>TSPNLGTRENNADQVTPVSHIGCPNTTQQGSPVFAKLLAKNQASLCNTTLNWHSQDG<br>AGSSYLSQGLRYEEDKKELVVDSPGLYYVFLELKLSPTFTNTGHKVQGWVSLVLQAK<br>PQVDDFDNLALTVELFPCSMENKLVDRSWSQLLLLKAGHRLSVGLRAYLHGAQDAYR<br>DWELSYPNTTSFGLFLVKPDNPWE (SEQ ID NO: 16) |
| Human<br>HVEM<br>(CD270) | >NM_003820.4 Homo sapiens TNF receptor superfamily member<br>14 (TNFRSF14), transcript variant 1, DNA<br>ATACCGGCCCTTCCCCTCGGCTTTGCCTGGACAGCTCCTGCCTCCCGCAGGGCCCAC<br>CTGTGTCCCCCAGCGCCGCTCCACCCAGCAGGCCTGAGCCCCTCTCTGCTGCCAGAC<br>ACCCCCTGCTGCCCACTCTCCTGCTGCTCGGGTTCTGAGGCACAGCTTGTCACACCG<br>AGGCGGATTCTCTTTCTCTTTCTCTTTCTGCCCACAGCCGCAGCAATGGCG<br>CTGAGTTCCTCTGCTGGAGTTCATCCTGCTAGCTGGGTTCCCGAGCTGCCGGTCTGA<br>GCCTGAGGCATGGAGCCTCCTGGAGACTGGGGGCTCCTCCCTGGAGATCCACCCCCC<br>AAAACCGACGTCTTGAGGCTGGTGCTGTATCTCACCTTCCTGGGAGCCCCCTGCTAC<br>GCCCCAGCTCTGCCGTCCTGCAAGGAGGACGAGTACCCAGTGGGCTCCGAGTGCTGC<br>CCCAAGTGCAGTCCAGGTTATCGTGTGAAGGAGGCCTGCGGGAGCTGACGGGCACA<br>GTGTGTGAACCCTGCCCTCCAGGCACCTACATTGCCCACCTCAATGGCCTAAGCAAG<br>TGTCTGCAGTGCCAAATGTGTGACCCAGCCATGGGCCTGCGCGCGAGCCGGAACTGC<br>TCCAGGACAGAGAACGCCGTGTGTGGCTGCAGCCCAGGCCACTTCTGCATCGTCCAG<br>GACGGGACCACTGCGCCGTGCCGCGCTTACGCCACCTCCAGCCCGGGCCAGAGG<br>GTGCAGAAGGGAGGCACCGAGAGTCAGGACACCCTGTCAGAACTGCCCCCCGGGG<br>ACCTTCTCTCCCAATGGGACCCTGGAGGAATGTCAGCACCAGACCAAGTGCAGCTGG<br>CTGGTGACGAAGGCCGAGCTGGGACCAGCAGCTCCCACTGGGTATGGTGGTTTCTC<br>TCAGGGAGCCTCGTCATCGTCATTGTTTGCTCCACAGTTGGCCTAATCATATGTGTG<br>AAAAGAAGAAAGCCAAGGGGTGATGTAGTCAAGGTGATCGTCTCCGTCCAGCGGAAA<br>AGACAGGAGGCAGAAGGTGAGGCCACAGTCATTGAGGCCCTGCAGGCCCCTCCGGAC |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | GTCACCACGGTGGCCGTGGAGGAGACAATACCCTCATTCACGGGGAGGAGCCCAAAC<br>CACTGACCCACAGACTCTGCACCCCGACGCCAGAGATACCTGGAGCGACGGCTGCTG<br>AAAGAGGCTGTCCACCTGGCGGAACCACCGGAGCCCGGAGGCTTGGGGGCTCCGCCC<br>TGGGCTGGCTTCCGTCTCCTCCAGTGGAGGGAGAGGTGGGGCCCCTGCTGGGGTAGA<br>GCTGGGGACGCCACGTGCCATTCCCATGGGCCAGTGAGGGCCTGGGGCCTCTGTTCT<br>GCTGTGGCCTGAGCTCCCCAGAGTCCTGAGGAGGAGCGCCAGTTGCCCCTCGCTCAC<br>AGACCACACACCCAGCCCTCCTGGGCCAGCCCAGAGGGCCCTTCAGACCCCAGCTGT<br>CTGCGCGTCTGACTCTTGTGGCCTCAGCAGGACAGGCCCCGGGCACTGCCTCACAGC<br>CAAGGCTGGACTGGGTTGGCTGCAGTGTGGTGTTTAGTGGATACCACATCGGAAGTG<br>ATTTTCTAAATTGGATTTGAATTCGGCTCCTGTTTTCTATTTGTCATGAAACAGTGT<br>ATTTGGGGAGATGCTGTGGGAGGATGTAAATATCTTGTTTCTCCTCAAA (SEQ ID<br>NO: 17)<br><br>>NP_003811.2 tumor necrosis factor receptor superfamily<br>member 14 isoform 1 precursor [Homo sapiens]<br>MEPPGDWGPPPWRSTPKTDVLRLVLYLTFLGAPCYAPALPSCKEDEYPVGSECCPKC<br>SPGYRVKEACGELTGTVCEPCPPGTYIAHLNGLSKCLQCQMCDPAMGLRASRNCSRT<br>ENAVCGCSPGHFCIVQDGDHCAACRAYATSSPGQRVQKGGTESQDTLCQNCPPGTFS<br>PNGTLEECQHQTKCSWLVTKAGAGTSSSHWVWWFLSGSLVIVIVCSTVGLIICVKRR<br>KPRGDVVKVIVSVQRKRQEAEGEATVIEALQAPPDVTTVAVEETIPSFTGRSPNH<br>(SEQ ID NO: 18) |
| Mouse HVEM (CD270) | >NM_178931.2 Mus musculus tumor necrosis factor receptor<br>superfamily, member 14 (herpesvirus entry mediator)<br>(Tnfrsf14), mRNA<br>GCTCTTGGCCTGAAGTTTCTTGATCAAGAAAATGGAACCTCTCCCAGGATGGGGGTC<br>GGCACCCTGGAGCCAGGCCCCTACAGACAACACCTTCAGGCTGGTGCCTTGTGTCTT<br>CCTTTTGAACTTGCTGCAGCGCATCTCTGCCCAGCCCTCATGCAGACAGGAGGAGTT<br>CCTTGTGGGAGACGAGTGCTGCCCCATGTGCAACCCAGGTTACCATGTGAAGCAGGT<br>CTGCAGTGAGCATACAGGCACAGTGTGTGCCCCCTGTCCCCCACAGACATATACCGC<br>CCATGCAAATGGCCTGAGCAAGTGTCTGCCCTGCGGAGTCTGTGATCCAGACATGGG<br>CCTGCTGACCTGGCAGGAGTGCTCCAGCTGGAAGGACACTGTGTGCAGATGCATCCC<br>AGGCTACTTCTGTGAGAACCAGGATGGGAGCCACTGTTCCACATGCTTGCAGCACAC<br>CACCTGCCCTCCAGGGCAGAGGGTAGAGAAGAGAGGGACTCACGACCAGGACACTGT<br>ATGTGCTGACTGCCTAACAGGGACCTTCTCACTTGGAGGGACTCAGGAGGAATGCCT<br>GCCCTGGACCAACTGCAGTGCATTTCAACAGGAAGTAAGACGTGGGACCAACAGCAC<br>AGACACCACCTGCTCCTCCCAGGTCGTCTACTACGTTGTGTCCATCCTTTTGCCACT<br>TGTGATAGTGGGAGCTGGGATAGCTGGATTCCTCATCTGCACGCGAAGACACCTGCA<br>CACCAGCTCAGTGGCCAAGGAGCTGGAGCCTTTTCAGGAACAACAGGAGAACACCAT<br>CAGGTTTCCAGTCACCGAGGTTGGGTTTGCTGAGACCGAGGAGGAGACAGCCTCCAA<br>CTGAACAAATTCTGGGTGACAAGACACCGAGGAGACGT (SEQ ID NO: 19)<br><br>>N5_849262.1 tumor necrosis factor receptor superfamily<br>member 14 precursor [Mus musculus]<br>MEPLPGWGSAPWSQAPTDNTFRLVPCVFLLNLLQRISAQPSCRQEEFLVGDECCPMC<br>NPGYHVKQVCSEHTGTVCAPCPPQTYTAHANGLSKCLPCGVCDPDMGLLTWQECSSW<br>KDTVCRCIPGYFCENQDGSHCSTCLQHTTCPPGQRVEKRGTHDQDTVCADCLTGTFS<br>LGGTQEECLPWTNCSAFQQEVRRGTNSTDTTCSSQVVYYVVSILLPLVIVGAGIAGF<br>LICTRRHLHTSSVAKELEPFQEQQENTIRFPVTEVGFAETEEETASN (SEQ ID<br>NO: 20) |
| Human FGL1 | >NM_004467.4 Homo sapiens fibrinogen like 1 (FGL1),<br>transcript variant 1, mRNA<br>AATGCAGTTACAGGATCCTGGGAAGCAGAGTGTCTGGATGGAACCTGAGCTGGGTCT<br>CTGACTCACTTCTGACTTTAGTTTTTTCAAGGGGGAACATGGCAAAGGTGTTCAGTT<br>TCATCCTTGTTACCACCGCTCTGACAATGGGCAGGGAAATTTCGGCGCTCGAGGACT<br>GTGCCCAGGAGCAGATGCGGCTCAGAGCCCAGGTGCGCCTGCTTGAGACCCGGGTCA<br>AACAGCAACAGGTCAAGATCAAGCAGCTTTTGCAGGAGAATGAAGTCCAGTTCCTTG<br>ATAAAGGAGATGAGAATACTGTCATTGATCTTGGAAGCAAGAGGCAGTATGCAGATT<br>GTTCAGAGATTTTCAATGATGGGTATAAGCTCAGTGGATTTTACAAAATCAAACCTC<br>TCCAGAGCCCAGCAGAATTTTCTGTTTATTGTGACATGTCCGATGGAGGAGGATGGA<br>CTGTAATTCAGAGACGATCTGATGGCAGTGAAAACTTTAACAGAGGATGGAAAGACT<br>ATGAAAATGGCTTTGGAAATTTTGTCCAAAAACATGGTGAATATTGGCTGGGCAATA<br>AAAATCTTCACTTCTTGACCACTCAAGAAGACTACACTTTAAAAATCGACCTTGCAG<br>ATTTTGAAAAAAATAGCCGTTATGCACAATATAAGAATTTCAAAGTTGGAGATGAAA<br>AGAATTTCTACGAGTTGAATATTGGGGAATATTCTGGAACAGCTGGAGATTCCCTTG<br>CGGGGAATTTTCATCCTGAGGTGCAGTGGTGGGCTAGTCACCAAAGAATGAAATTCA<br>GCACGTGGGACAGAGATCATGACAACTATGAAGGGAACTGCGCAGAAGAAGATCAGT<br>CTGGCTGGTGGTTTAACAGGTGTCACTCTGCAAACCTGAATGGTGTATACTACAGCG<br>GCCCCTACACGGCTAAAACAGACAATGGGATTGTCTGGTACACCTGGCATGGGTGGT<br>GGTATTCTCTGAAATCTGTGGTTATGAAAATTAGGCCAAATGATTTTATTCCAAATG<br>TAATTTAATTGCTGCTGTTGGGCTTTCGTTTCTGCAATTCAGCTTTGTTTAAAGTGA<br>TTTGAAAAATACTCATTCTGAACATATCCATGCGCAATCATGATAACTGTTGTGAGT<br>AGTGCTTTTCATTCTTCTCACTTGCCTTTGTTACTTAATGTGCTTTCAGTACAGCAG<br>ATATGCAATATTCACCAAATAAATGTGAGCTGTGTTAATA (SEQ ID NO: 21) |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | >NP_004458.3 fibrinogen-like protein 1 precursor [Homo sapiens]<br>MAKVFSFILVTTALTMGREISALEDCAQEQMRLRAQVRLLETRVKQQQVKIKQLLQE<br>NEVQFLDKGDENTVIDLGSKRQYADCSEIFNDGYKLSGFYKIKPLQSPAEFSVYCDM<br>SDGGGWTVIQRRSDGSENFNRGWKDYENGFGNFVQKHGEYWLGNKNLHFLTTQEDYT<br>LKIDLADFEKNSRYAQYKNFKVGDEKNFYELNIGEYSGTAGDSLAGNFHPEVQWWAS<br>HQRMKFSTWDRDHDNYEGNCAEEDQSGWWFNRCHSANLNGVYYSGPYTAKTDNGIVW<br>YTWHGWWYSLKSVVMKIRPNDFIPNVI (SEQ ID NO: 22) |
| Mouse FGL1 | >NM_145594.2 Mus musculus fibrinogen-like protein 1 (Fgl1), mRNA<br>GTTAGAAGTTCCTGGGAGGCTCTGTGTGGATGGACTGAGCCTAGCTAAGTCCTGATT<br>CATTTTGACTTGAGTTCTCTCAGTGGGAAGAATGGGAAAGATTTACAGCTTCGTCCT<br>GGTCGCCATTGCTCTGATGATGGGAAGGGAAGGTTGGGCCCTCGAGAGTGAGAACTG<br>CTTGCGGGAGCAGGTGAGGCTCAGGGCTCAGGTGCACCAGCTTGAGACCCGGGTCAA<br>ACAACAACAGACCATGATTGCACAGCTCTTGCATGAGAAGGAAGTCCAGTTTCTGGA<br>TAAAGGATCGGAGAACAGTTTCATTGACCTTGGAGGCAAGAAGCAGTATGCAGATTG<br>TTCAGAGATTTACAATGACGGATTTAAGCAGAGTGGATTTTACAAAATCAAACCTCT<br>TCAGAGCCTGGCAGAATTCTCTGTTTATTGTGACATGTCTGATGGAGGGGGATGGAC<br>TGTAATTCAGAGACGATCTGATGGCAGTGAGAACTTTAACAGGGGTTGGAATGACTA<br>TGAAAATGGCTTTGGAAACTTTGTCCAAAACAATGGCGAATACTGGCTGGGTAACAA<br>AAACATTAACTTGCTAACTATTCAAGGAGACTACACTTTAAAAATCGACCTGACAGA<br>TTTTGAGAAAAACAGCAGCTTCGCACAATACCAAAGTTTTAAAGTTGGTGATAAAAA<br>GTCTTTTTATGAACTAAATATTGGAGAATATTCTGGCACAGCTGGAGATTCCCTGTC<br>AGGAACTTTTCATCCTGAAGTACAGTGGTGGGCTAGTCACCAAAGGATGAAGTTCAG<br>CACGTGGGACAGAGATAACGACAATTACCAAGGAAACTGTGCTGAGGAAGAGCAGTC<br>TGGCTGGTGGTTTAACAGGTGTCACTCTGCAAACCTGAACGGTGTTTACTACCGTGG<br>TTCCTACAGGGCAGAAACGGATAATGGTGTTGTGGTACACCTGGCATGGGTGGTG<br>GTATTCCTTGAAATCTGTGGTTATGAAAATTAGGCCAAGTGATTTTATTCCAAATAT<br>TATTTAGTTGCCCTCATTGGGATCTCCTTTCTGTAATTCATCTTGGTTTACTTGAAA<br>ATAAATATTTGAAAAAGATATAATTCTGAATAACACA (SEQ ID NO: 23)<br><br>>NP_663569.2 fibrinogen-like protein 1 precursor [Mus musculus]<br>MGKIYSFVLVAIALMMGREGWALESENCLREQVRLRAQVHQLETRVKQQQTMIAQLL<br>HEKEVQFLDKGSENSFIDLGGKKQYADCSEIYNDGFKQSGFYKIKPLQSLAEFSVYC<br>DMSDGGGWTVIQRRSDGSENFNRGWNDYENGFGNFVQNNGEYWLGNKNINLLTIQGD<br>YTLKIDLTDFEKNSSFAQYQSFKVGDKKSFYELNIGEYSTAGDSLSGTFHPEVQWW<br>ASHQRMKFSTWDRDNDNYQGNCAEEEQSGWWFNRCHSANLNGVYYRGSYRAETDNGV<br>VWYTWHGWWYSLKSVVMKIRPSDFIPNII (SEQ ID NO: 24) |
| Human OX-2 (CD200) | >NM_005944.7 Homo sapiens CD200 molecule (CD200), transcript variant 1, mRNA<br>AGAGCTCCAGGCGCACATCCGCAGTCAGCCACCTCGCGCGCGCCTCCAGGAGCAAGG<br>ATGGAGAGGCTGGTGATCAGGATGCCCTTCTCTCATCTGTCTACCTACAGCCTGGTT<br>TGGGTCATGGCAGCAGTGGTGCTGTGCACAGCACAAGTGCAAGTGGTGACCCAGGAT<br>GAAAGAGAGCAGCTGTACACACCTGCTTCCTTAAAATGCTCTCTGCAAAATGCCCAG<br>GAAGCCCTCATTGTGACATGGCAGAAAAAGAAAGCTGTAAGCCCAGAAAACATGGTC<br>ACCTTCAGCGAGAACCATGGGGTGGTGATCCAGCCTGCCTATAAGGACAAGATAAAC<br>ATTACCCAGCTGGGACTCCAAAACTCAACCATCACCTTCTGGAATATCACCCTGGAG<br>GATGAAGGGTGTTACATGTGTCTCTTCAATACCTTTGGTTTTGGGAAGATCTCAGGA<br>ACGGCCTGCCTCACCGTCTATGTACAGCCCATAGTATCCCTTCACTACAAATTCTCT<br>GAAGACCACCTAAATATCACTTGCTCTGCCACTGCCCGCCCAGCCCCCATGGTCTTC<br>TGGAAGGTCCCTCGGTCAGGGATTGAAAATAGTACAGTGACTCTGTCTCACCCAAAT<br>GGGACCACGTCTGTTACCAGCATCCTCCATATCAAAGACCCTAAGAATCAGGTGGGG<br>AAGGAGGTGATCTGCCAGGTGCTGCACCTGGGGACTGTGACCGACTTTAAGCAAACC<br>GTCAACAAAGGCTATTGGTTTTCAGTTCCGCTATTGCTAAGCATTGTTTCCCTGGTA<br>ATTCTTCTCGTCCTAATCTCAATCTTACTGTACTGGAAACGTCACCGGAATCAGGAC<br>CGAGAGCCCTAAATAAGTCACACAGCACCCTGAAAGTGATTCCCTGGTCTACTTGAA<br>TTTGACACAAGAGAAAAGCAGGAGGAAAAGGGGCCATTCTCCAAAGGACCTGAAAGA<br>GCAAAAGAGGTGGGAGCGAAAGCCTTAAGGATCCCACGACTTTTTACTGCCATCTGA<br>GCTACTCAGTGTTTGAATCCCAAGAGGAAGTCAGTTTACCTCTCAGGTCTGTTGTAG<br>GACTTGATTTTGTAAAGCAATGCCATGTTATGTGGTTGAAAGGGCACTGGACTTAGT<br>TAGTATCAGGAGCACTGAGCTCACAGACTGACTTGGGCTCCTACTGGTGGGGACCTC<br>TGTTAGTCACTTTACCTCATCCAAAGTATAAAGGAATTGGACCAAATAATTTACCAC<br>ATAGCTCTAAAACTTAATTTAAAATGTAATTCCAGAAAAAAAAGGGAATAAGCAAA<br>GGGGGAAGAATTGAAAGAGAGAGAAGAAAGAATACAGAGAGCTTACCTTTTGCCT<br>TTCTGTTGATGTTACATCTCTTCTTCCTATGTTCTTAGGTCTATGAGTCTGTTTCCC<br>CATCATTTGGTATCTAGTCCAGTTCCTGCTTACTGCTTTGCTAATAGCTGGCCTTGC<br>TAGAATCCTTGGTTTCACTGCTGTTCTTCATGTGCTTCTATGAGATTTACTCCAACA<br>CAAATAGGACTGAATTTATTGTGAAGTAACATTGGCAATCTTAACTTATTCATTTAA<br>CTTATTTTTATAGCTAGATAAATATTGTTAGTCTTAGACAATAGCTCACATTTTTTG<br>AGAAGCATGCCCTCCCTGTCCATTTGTCTTATAACATGACCCAGCCCTATTTTACGT<br>CATTCTAAATTCAGCCTCATATAATGAAAATACATTATGAAAACAGATGTTTAGGAG |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | ATTTCCTGTATAGCAGTCAGCCAATTCATATGCTTTGTCTCTGCTGGCTTCTTTTTC<br>CATGCGTTAACTTTTCCCAATAGCAGAGGAGGCAAATATGAGCATACAATCCCTTTG<br>TTCTAAAGATATTGTTCCAGCTAGTGGAATGATGTTGAATCTTTAATAACCATAATT<br>AGTTGCTTTTTCAGTATCTTCTGCTTTGTCTGTGTCTATCCAGTGGCCTAGGAATTA<br>AAGTGTAAGTTGTTTTCGCTGTTAAATTGGATATTTATATATATATATAGCAAGATT<br>TTCATGTGTTATTTAATTCTGTATTGTTTCTTATATTTGTAGTAAAATATTGAACAA<br>TTAAAAGTGTTGACTCCAAA (SEQ ID NO: 25)<br><br>>NP_005935.4 OX-2 membrane glycoprotein isoform a<br>precursor [Homo sapiens]<br>MERLVIRMPFSHLSTYSLVWVMAAVVLCTAQVQVVTQDEREQLYTPASLKCSLQNAQ<br>EALIVTWQKKKAVSPENMVTFSENHGVVIQPAYKDKINITQLGLQNSTITFWNITLE<br>DEGCYMCLFNTFGFGKISGTACLTVYVQPIVSLHYKFSEDHLNITCSATARPAPMVF<br>WKVPRSGIENSTVTLSHPNGTTSVTSILHIKDPKNQVGKEVICQVLHLGTVTDFKQT<br>VNKGYWFSVPLLLSIVSLVILLVLISILLYWKRHRNQDREP (SEQ ID NO: 26) |
| Mouse OX-2<br>(CD200) | >NM_010818.3 Mus musculus CD200 antigen (Cd200),<br>transcript variant 1, mRNA<br>GGGCGTGGTTGGTTGGTCGTCTCTTCCTCCACACTAGAGGAGCTGTAGAGTCTGCCT<br>GTGCAGTGGAGGGGGCTCTCTCTACGGCGAATAGTAGTGTCCCTGCTCACAGGTGTT<br>GCGGAGATATCCTCCATCGTGGAAGAGCTCAGACCCCGAGAAGCTGGTGTCTAGCTG<br>CGGCCCAGAGCAAGGATGGGCAGTCTGGTATTCAGGAGACCTTTCTGCCATCTCTCC<br>ACCTACAGCCTGATTTGGGGCATGGCAGCAGTAGCGCTGAGCACAGCTCAAGTGGAA<br>GTGGTGACCCAGGATGAAAGAAAGGCGCTGCACACAACTGCATCCTTACGATGTTCT<br>CTAAAAACATCCCAGGAACCCTTGATTGTGACATGGCAGAAAAAGAAAGCCGTGAGC<br>CCAGAAAACATGGTCACCTACAGCAAAACCCATGGGGTTGTAATCCAGCCTGCCTAC<br>AAAGACAGGATAAATGTCACAGAGCTGGGACTCTGGAACTCAAGCATCACCTTCTGG<br>AACACAACATTGGAAGATGAGGGCTGCTACATGTGTCTCTTCAACACGTTTGGTTCT<br>CAGAAGGTCTCAGGAACAGCTTGCCTTACCCTCTATGTACAGCCCATAGTACACCTT<br>CACTACAACTATTTTGAAGACCACCTAAACATCACTTGCTCTGCGACTGCCCGTCCA<br>GCCCCTGCCATCTCCTGGAAGGGTACTGGGACAGGAATTGAGAATAGTACCGAGAGT<br>CACTTCCATTCAAATGGGACTACATCTGTCACCAGCATCCTCCGGGTCAAAGACCCC<br>AAAACTCAAGTTGGGAAGGAAGTGATCTGCCAGGTTTTATACCTGGGGAATGTGATT<br>GACTACAAGCAGAGTCTGGACAAAGGATTTTGGTTTTCAGTTCCACTGTTGCTAAGC<br>ATTGTTTCTCTGGTAATTCTTCTGATCTTGATCTCCATCTTACTATACTGGAAACGT<br>CACCGAAATCAGGAGCGGGGTGAATCATCACAGGGGATGCAAAGAATGAAATAAGAG<br>CTCTAAAGAAATTATACAGAACCCTGAACGTGTTTCCCTGGTCTACTTGAATCTGAT<br>GTGAAAGAAAAGCAGGAGGGAAAAGGCCATTCTCCATAGGACCTAAGGAGAGCAAAA<br>GACCAGACACGAGCCTGTGAGGGATTTGACTTTTTGCTGTTGTCCCAGGTCCTCGGT<br>GTTTGCATTCCAAGAGGAAGTCGAGTGCCTCGGGTCTGTTGTAGGACTTGATTTTTT<br>TTTTTTTTGTAGAGCAATGCAGTGCCATGCTGTTAGAAAGGCTCCAGACTTAGAACC<br>ACCAGTGCCAAGCCAGCTCTCAGACCGACTAGGGCTCCCATCGGAGGAACAAATCGT<br>AGTCAACTTACCTCACAGAGCTCTCTGGTCCTTACACAAAGTAGAAAGGAGTGGGAC<br>CAGAAAATTGGCCATGTCTGAAATCTGATGGAATTTTTAGGAAGAAAACTGAAGAAT<br>AAGCAAAAGAAGAAAGAACACAGAAGGGTCCAAAGAGCTTCTGAGAGTACCTTTTGC<br>CTTTCTGTTGGTGTCCCAGCTCTGGTTTTGTTCTTAGGTCCGCCAGTGTGTTTCCCT<br>GTTGTTTGAGTATCTAGTTGACTACCTGCTACTGTTCTGCTGATGGTTGGCCTTGCT<br>AGAATCCCTGACTCCCCTGCCGTTCTCTATGTGCTTCATGAGGGTTACTATGATGA<br>AATATAGAGCAGAAGATAGTGTGAAGTAACATTGGCAACTGTAATGTGTCCATTTAAC<br>TTATTTTTATAGCACTTAGGCAATATTGTTAGTCTTAGTGAGTAGTTCACATCTTTA<br>CAAAAGCATGCTCTCCCTATCCATTGGGCCCACAATAACACTCTCTTTGAGGCCATT<br>CTGAATCCTGTCTCGTGTAATGATAATATATTATGAAAACAGATACTTTAAGAATTT<br>CCTGTACAGCAGTCAGTTGTTTATTCTCTCTCTCTCTCTCTCTCTCCCTCC<br>CCCACCCCAGCTTCTTTTTCTGTGACTTTGTTTTTCATAAAGAGAAGGCATCTCCTG<br>AATACAATCGCTTTGTTCTGAAGACATCGTGAACTATTAATTCTTAACCCTTTGACA<br>AAACTAGTGAAGTTGTTTTCTGTATCTTTTGCTTCATCTGTCTTTATAGAGTGACCT<br>AGGAATTCAAGTGTAAGTTGTTTCCATTGTTGAACTGGATATTTATATACTTGGTAT<br>GCTTTTCACGTGTTATTTAATTCTGTATAATTTCCTATATTTGTATTAAAATATTGA<br>GCAATTAAAAGTGTCAACTAAATATTTGATGTGGCATTCCCTTGAGAAATATAGAAA<br>TAAAGAATAAAAAAAAAAAAAAAAAA (SEQ ID NO: 27)<br><br>>NP_034948.3 OX-2 membrane glycoprotein isoform 1<br>precursor [Mus musculus]<br>MGSLVFRRPFCHLSTYSLIWGMAAVALSTAQVEVVTQDERKALHTTASLRCSLKTSQ<br>EPLIVTWQKKKAVSPENMVTYSKTHGVVIQPAYKDRINVTELGLWNSSITFWNTTLE<br>DEGCYMCLENTFGSQKVSGTACLTLYVQPIVHLHYNYFEDHLNITCSATARPAPAIS<br>WKGTGTGIENSTESHFHSNGTTSVTSILRVKDPKTQVGKEVICQVLYLGNVIDYKQS<br>LDKGFWFSVPLLLSIVSLVILLLILISILLYWKRHRNQERGESSQGMQRMK (SEQ ID<br>NO: 28) |
| Human<br>Galectin-9 | >NM_009587.3 Homo sapiens galectin 9 (LGALS9), transcript<br>variant 1, mRNA<br>CTTTGTTAAGTCGTTCCCTCTACAAAGGACTTCCTAGTGGGTGTGAAAGGCAGCGGT<br>GGCCACAGAGGCGGCGGAGAGATGGCCTTCAGCGGTTCCCAGGCTCCCTACCTGAGT<br>CCAGCTGTCCCCTTTTCTGGGACTATTCAAGGAGGTCTCCAGGACGGACTTCAGATC |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | ACTGTCAATGGGACCGTTCTCAGCTCCAGTGGAACCAGGTTTGCTGTGAACTTTCAG<br>ACTGGCTTCAGTGGAAATGACATTGCCTTCCACTTCAACCCTCGGTTTGAAGATGGA<br>GGGTACGTGGTGTGCAACACGAGGCAGAACGGAAGCTGGGGGCCCGAGGAGGAGGAAG<br>ACACACATGCCTTTCCAGAAGGGGATGCCCTTTGACCTCTGCTTCCTGGTGCAGAGC<br>TCAGATTTCAAGGTGATGGTGAACGGGATCCTCTTCGTGCAGTACTTCCACCGCGTG<br>CCCTTCCACCGTGTGGACACCATCTCCGTCAATGGCTCTGTGCAGCTGTCCTACATC<br>AGCTTCCAGAACCCCCGCACAGTCCCTGTTCAGCCTGCCTTCTCCACGGTGCCGTTC<br>TCCCAGCCTGTCTGTTTCCCACCCAGGCCCAGGGGGCGCAGACAAAAACCTCCCGGC<br>GTGTGGCCTGCCAACCCGGCTCCCATTACCCAGACAGTCATCCACACAGTGCAGAGC<br>GCCCCTGGACAGATGTTCTCTACTCCCGCCATCCCACCTATGATGTACCCCCACCCC<br>GCCTATCCGATGCCTTTCATCACCACCATTCTGGGAGGGCTGTACCCATCCAAGTCC<br>ATCCTCCTGTCAGGCACTGTCCTGCCCAGTGCTCAGAGGTTCCACATCAACCTGTGC<br>TCTGGGAACCACATCGCCTTCCACCTGAACCCCCGTTTTGATGAGAATGCTGTGGTC<br>CGCAACACCCAGATCGACAACTCCTGGGGGTCTGAGGAGCGAAGTCTGCCCCGAAAA<br>ATGCCCTTCGTCCGTGGCCAGAGCTTCTCAGTGTGGATCTTGTGTGAAGCTCACTGC<br>CTCAAGGTGGCCGTGGATGGTCAGCACCTGTTTGAATACTACCATCGCCTGAGGAAC<br>CTGCCCACCATCAACGACTGGAAGTGGGGGGCGACATCCAGCTGACCCATGTGCAG<br>ACATAGGCGGCTTCCTGGCCCTGGGGCCGGGGCTGGGGTGTGGGGCAGTCTGGGTC<br>CTCTCATCATCCCCACTTCCCAGGCCCAGCCTTTCCAACCCTGCCTGGGATCTGGGC<br>TTTAATGCAGAGGCCATGTCCTTGTCTGGTCCTGCTTCTGGCTACAGCCACCCTGGA<br>ACGGAGAAGGCAGCTGACGGGATTGCCTTCCTCAGCCGCAGCAGCACCTGGGGCTC<br>CAGCTGCTGGAATCCTACCATCCCAGGAGGCAGGCACAGCCAGGGAGAGGGGAGGAG<br>TGGGCAGTGAAGATGAAGCCCCATGCTCAGTCCCCTCCCATCCCCCACGCAGCTCCA<br>CCCCAGTCCCAAGCCACCAGCTGTCTGCTCCTGGTGGGAGGTGGCCTCCTCAGCCCC<br>TCCTCTCTGACCTTTAACCTCACTCTCACCTTGCACCGTGCACCAACCCTTCACCCC<br>TCCTGGAAAGCAGGCCTGATGGCTTCCCACTGGCCTCCACCACCTGACCAGAGTGTT<br>CTCTTCAGAGGACTGGCTCCTTTCCCAGTGTCCTTAAAATAAAGAAATGAAAATGCT<br>TGTTGGCACATTCA (SEQ ID NO: 29)<br><br>>NP_033665.1 galectin-9 isoform long [Homo sapiens]<br>MAFSGSQAPYLSPAVPFSGTIQGGLQDGLQITVNGTVLSSSGTRFAVNFQTGFSGND<br>IAFHFNPRFEDGGYVVCNTRQNGSWGPEERKTHMPFQKGMPFDLCFLVQSSDFKVMV<br>NGILFVQYFHRVPFHRVDTISVNGSVQLSYISFQNPRTVPVQPAFSTVPFSQPVCFP<br>PRPRGRRQKPPGVWPANPAPITQTVIHTVQSAPGQMFSTPAIPPMMYPHPAYPMPFI<br>TTILGGLYPSKSILLSGTVLPSAQRFHINLCSGNHIAFHLNPRFDENAVVRNTQIDN<br>SWGSEERSLPRKMPFVRGQSFSVWILCEAHCLKVAVDGQHLFEYYHRLRNLPTINRL<br>EVGGDIQLTHVQT (SEQ ID NO: 30) |
| Mouse Galectin-9 | >NM_010708.2 Mus musculus lectin, galactose binding, soluble 9 (Lgals9), transcript variant 1, mRNA<br>GCCAAATAGCTGTGGTTTCTGTTTCCTAGCTCAGCCCTGCCCTGCGCAGAGTTCTGT<br>CGTCCACCATCGAGTGAGGAAGAGAGCATTGGTTCCCCTGAGATAGAAGAGATGGCT<br>CTCTTCAGTGCCCAGTCTCCATACATTAACCCGATCATCCCCTTTACTGGACCAATC<br>CAAGGAGGGCTGCAGGAGGGACTTCAGGTGACCCTCCAGGGGACTACCAAGAGTTTT<br>GCACAAAGGTTTGTGGTGAACTTTCAGAACAGCTTCAATGGAAATGACATTGCCTTC<br>CACTTCAACCCCCGGTTTGAGGAAGGAGGGTATGTGGTTTGCAACACGAAGCAGAAC<br>GGACAGTGGGGTCCTGAGGAGAGAAAGATGCAGATGCCCTTCCAGAAGGGGATGCCC<br>TTTGAGCTTTGCTTCCTGGTGCAGAGGTCAGAGTTCAAGGTGATGGTGAACAAGAAA<br>TTCTTTGTGCAGTACCAACACCGCGTACCCTACCACCTCGTGGACACCATCGCTGTC<br>TCCGGCTGCTTGAAGCTGTCCTTTATCACCTTCCAGAACTCTGCAGCCCCTGTCCAG<br>CATGTCTTCTCCACAGTGCAGTTCTCTCAGCCAGTCCAGTTCCCACGGACCCCTAAG<br>GGGCGCAAACAGAAAACTCAGAACTTTCGTCCTGCCCACCAGGCACCCATGGCTCAA<br>ACTACCATCCATATGGTTCACAGCACCCCTGGACAGATGTTCTCTACTCCTGGAATC<br>CCTCCTGTGGTGTACCCCACCCCAGCCTATACCATACCTTTCTACACCCCCATTCCA<br>AATGGGCTTTACCCGTCCAAGTCCATCATGATATCAGGCAATGTCTTGCCAGATGCT<br>ACGAGGTTCCATATCAACCTTCGCTGTGGAGGTGACATTGCTTTCCACCTGAACCCC<br>CGTTTCAATGAGAATGCTGTTGTCCGAAACACTCAGATCAACAACTCCTGGGGGCAG<br>GAAGAGCGAAGTCTGCTTGGGAGGATGCCCTTCAGTCGAGGCCAGAGCTTCTCGGTG<br>TGGATCATATGTGAAGGTCACTGCTTCAAGGTAGCTGTGAATGGTCAACACATGTGT<br>GAATATTACCACCGCCTGAAGAACTTGCAGGATATCAACACTCTAGAAGTGGCGGGT<br>GATATCCAGCTGACCCACGTGCAGACATAGGCAAGGTCTCTGGCCTAGGGATAAGGG<br>CTGGAGCACTCTGCCTGTGTCTTATCTTTCCCCTGTCTCAGCCCTGGCACCATCAGA<br>AGAGATCATCACTTATAGGAATTCCAGGAAGGTGAAATTCCCAATTGACTCCCTCCA<br>CAAAGGGGGTTTTCTAGGCTGTGTGGCACATGGCTGTCAGCCCATAGTCTGAGCCAT<br>TGCCCCCAAGCTAGCTATATACTGAGGGAAGTGACCCTCCTGGGTTTGCTCAGATCT<br>CTGATCGTTCCCCCCTCTGTGGCCCTTTTCTTTCACCCCTCCAGGAGAGCCACCCTG<br>ATATCATCCCACTGGCCTCCAACTGACCCACAATGTCCACAGTAACTTTCCCCCATT<br>CTCACCCAGTATCCATAAAATAAAGAAATAATATTGCTTGTCTACAC (SEQ ID NO: 31)<br><br>>NP_034838.2 galectin-9 isoform 1 [Mus musculus]<br>MALFSAQSPYINPIIPFTGPIQGGLQEGLQVTLQGTTKSFAQRFVVNFQNSFNGNDI<br>AFHFNPRFEEGGYVVCNTKQNGQWGPEERKMQMPFQKGMPFELCFLVQRSEFKVMVN<br>KKFFVQYQHRVPYHLVDTIAVSGCLKLSFITFQNSAAPVQHVFSTVQFSQPVQFPRT<br>PKGRKQKTQNFRPAHQAPMAQTTIHMVHSTPGQMFSTPGIPPVVYPTPAYTIPFYTP |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | IPNGLYPSKSIMISGNVLPDATRFHINLRCGGDIAFHLNPRFNENAVVRNTQINNSW<br>GQEERSLLGRMPFSRGQSFSVWIICEGHCFKVAVNGQHMCEYYHRLKNLQDINTLEV<br>AGDIQLTHVQT (SEQ ID NO: 32) |
| Human PVR (CD155) | >NM_006505.5 Homo sapiens PVR cell adhesion molecule (PVR), transcript variant 1, mRNA<br>AGTCACTTGTCTGGAGCTTGAAGAAGTGGGTATTCCCCTTCCCACCCCAGGCACTGG<br>AGGAGCGGCCCCCCGGGGATTCCAGGACCTGAGCTCCGGGAGCTGGACTCGCAGCGA<br>CCGCGGCAGAGCGAGCGGGCGCCGGGAAGCGAGGAGACGCCCGCGGGAGGCCCAGCT<br>GCTCGGAGCAACTGGCATGGCCCGAGCCATGGCCGCCGCGTGGCCGCTGCTGCTGGT<br>GGCGCTACTGGTGCTGTCCTGGCCACCCCCAGGAACCGGGGACGTCGTCGTGCAGGC<br>GCCCACCCAGGTGCCCGGCTTCTTGGGCGACTCCGTGACGCTGCCCTGCTACCTACA<br>GGTGCCCAACATGGAGGTGACGCATGTGTCACAGCTGACTTGGGCGCGGCATGGTGA<br>ATCTGGCAGCATGGCCGTCTTCCACCAAACGCAGGGCCCCAGCTATTCGGAGTCCAA<br>ACGGCTGGAATTCGTGGCAGCCAGACTGGGCGCGGAGCTGCGGAATGCCTCGCTGAG<br>GATGTTCGGGTTGCGCGTAGAGGATGAAGGCAACTACACCTGCCTGTTCGTCACGTT<br>CCCGCAGGGCAGCAGGAGCGTGGATATCTGGCTCCGAGTGCTTGCCAAGCCCCAGAA<br>CACAGCTGAGGTTCAGAAGGTCCAGCTCACTGGAGAGCCAGTGCCCATGGCCCGCTG<br>CGTCTCCACAGGGGGTCGCCCGCCAGCCCAAATCACCTGGCACTCAGACCTGGGCGG<br>GATGCCCAATACGAGCCAGGTGCCAGGGTTCCTGTCTGGCACAGTCACTGTCACCAG<br>CCTCTGGATATTGGTGCCCTCAAGCCAGGTGGACGGCAAGAATGTGACCTGCAAGGT<br>GGAGCACGAGAGCTTTGAGAAGCCTCAGCTGCTGACTGTGAACCTCACCGTGTACTA<br>CCCCCCAGAGGTATCCATCTCTGGCTATGATAACAACTGGTACCTTGGCCAGAATGA<br>GGCCACCCTGACCTGCGATGCTCGCAGCAACCCAGAGCCCACAGGCTATAATTGGAG<br>CACGACCATGGGTCCCCTGCCACCCTTTGCTGTGGCCCAGGGCGCCCAGCTCCTGAT<br>CCGTCCTGTGGACAAACCAATCAACACAACTTTAATCTGCAACGTCACCAATGCCCT<br>AGGAGCTCGCCAGGCAGAACTGACCGTCCAGGTCAAAGAGGGACCTCCCAGTGAGCA<br>CTCAGGCATGTCCCGTAACGCCATCATCTTCCTGGTTCTGGGAATCCTGGTTTTTCT<br>GATCCTGCTGGGGATCGGGATTTATTTCTATTGGTCCAAATGTTCCCGTGAGGTCCT<br>TTGGCACTGTCATCTGTGTCCCTCGAGTACAGAGCATGCCAGCGCCTCAGCTAATGG<br>GCATGTCTCCTATTCAGCTGTGAGCAGAGAGAACAGCTCTTCCCAGGATCCACAGAC<br>AGAGGGCACAAGGTGACAGCGTCGGGACTGAGAGGGGAGAGAGACTGGAGCTGGCAA<br>GGACGTGGGCCTCCAGAGTTGGACCCGACCCCAATGGATGAAGACCCCCTCCAAAGA<br>GACCAGCCTCCCTCCCTGTGCCAGACCTCAAAACGACGGGGGCAGGTGCAAGTTCAT<br>AGGTCTCCAAGACCACCCTCCTTTCATTTGCTAGAAGGACTCACTAGACTCAGGAAA<br>GCTGTTAGGCTCACAGTTACAGTTTATTACAGTAAAAGGACAGAGATTAAGATCAGC<br>AAAGGGAGGAGGTGCACAGCACACGTTCCACGACAGATGAAGGCGACGGCTTCCATCT<br>GCCCTCTCCCAGTGGAGCCATATAGGCAGCACCTGATTCTCACAGCAACATGTGACA<br>ACATGCAAGAAGTACTGCCAATACTGCCAACCAGAGCAGCTCACTGGAGATCTTTGT<br>GTCCAGAGTTTTTTGTTTGTCTTGAGACAGGGTCTGGCTCTGTTGGCAGACTAGAGT<br>ACAGTGGTGAGATCACAGTTCATTGCAGCCTTGACTTCTCAACGCCAAGTCATCCTC<br>CCACCTCAGCCTCCTGAGTAGCTATGACTACAGGTATGTGCCACCACGTCTGGCTAA<br>TCTTTTTATTATTTGTAAAGTCGAGGTTTCCCTGTGTTGCCCAGGCTGGTCTTGAAC<br>TCTTGGCTCCAAGTGATACTTCTGCCTTGGCCTCCCAAAGTGCTGAATTAAGCAGCT<br>CACCATCCACACGGCTGACCTCATACATCAAGCCAATACCGTGTGGCCCAAGACCCC<br>CACCATAAATCACATCATTAGCATGAACCACCCAGAGTGGCCCAAGACTCCAAGATC<br>AGCTACCAGGCAGGATATTCCAAGGGCTTAGAGATGAATGCCCAGGAGCTGAGGATA<br>AAGGGCCCGATCTTTCTTTGGGCAAGGTTAAGCCTTTACTGCATAGCAGACCACACA<br>GAAGGGTGTGGGCCACCAGAGAATTTTGGTAAAAATTTGGCCTCTGGCCTTGAGCTT<br>CTAAATCTCTGTATCCGTCAGATCTCTGTGGTTACAAGAAACAGCCACTGACCCTGG<br>TCACCAGAGGCTGCAATTCAGGCCGCAAGCAGCTGCCTGGGGGGTGTCCAAGGAGCA<br>GAGAAAACTACTAGATGTGAACTTGAAGAAGGTTGTCAGCTGCAGCCACTTTCTGCC<br>AGCATCTGCAGCCACTTTCTGCCAGCATCTGCAGCCAGCAAGCTGGGACTGGCAGGA<br>AATAACCCACAAAAGAAGCAAATGCAATTTCCAACACAAGGGGGAAGGGATGCAGGG<br>GGAGGCAGCGCTGCAGTTGCTCAGGACACGCTCCTATAGGACCAAGATGGATGCGAC<br>CCAAGACCCAGGAGGCCCAGCTGCTCAGTGCAACTGACAAGTTAAAAAGGTCTATGA<br>TCTTGAGGGCAGACAGCAGAATTCCTCTTATAAAGAAAACTGTTTGGGAAAATACGT<br>TGAGGGAGAGAAGACCTTGGGCCAAGATGCTAAATGGGAATGCAAAGCTTGAGCTGC<br>TCTGCAAGAGAAAATAAGCAGGACAGAGGATTTGCTCTGGACAGAGATGGAAGAGCC<br>GGGAACAGAGAAGTGTGGGGAAGAGATAGGAACCAGCAGGATGGCAGGGCAAAGGG<br>CTCAAGGGTGAGGAGGCCAGTGGGACCCCACAGAGTTGGGGAGATAAAGGAACATTG<br>GTTGCTTTGGTGGCACGTAAGCTCCTTGCTGTCTCCAGCACCCAGAATCTCATTAA<br>AGCTTATTTATTGTACCTCCAGCGGCTGTGTGCAATGGGGTCTTTTGTGGAAATCAA<br>GGAGCAGACAGGTTTCATGTGTACTGTCACCACGTGGGATGGAACCAGAGGCATGGA<br>AGCAAGACGCTAAATGAAGAGGGCCATAAGGGCTGGGATTCCCAGGCACCTTAGGAA<br>CAGCTTGTCTTTTTTTTTCCTCTCAAAAAAAATGTTTAAGGGACGGTGTCTCCT<br>GTCACCCAGGCTGGAGTGCAATGGCACGATCATAGCTCATTGCAGCCTCTAACTCCG<br>GGGCTCAAGCAATCCTCCCACCTCAGCCTACCAAGTAGCTGTGACCACAGCTGCCCC<br>TCACCATGCTAAGCTAATTTTTTTAATTAGATAGTACATAAACGTCCCAAAATTAGA<br>AGATAAAAAGACATGAGGGATCCATTCTAATTTGTGTTTGGAGTGTAATGGTCCAGC<br>TCCATTCTTCTGCACATGGATATCCAGTTTTACACAACACTGTGAATGTAATGAATG<br>CCACTGAATCATACACTCAAAAATAGCTAAAATGGCAAATTGTCTGTTATCTCTTTT<br>TAACCACCATTTTTGAAAATTAATTATACCAAAAAACCATTGAATAGTGCACTTTAT<br>TTATTTATTTATTTGTTTATTTATTTATTTTAGAAATAAGAGTCTCACTTTGT<br>TGCCCAGGCTGGAGTGCAGTGGCGTGATCATGGCTCATTGCAGCCTCGACCTGCTGG |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | GCTCGGGCTATCCTTCCATCTCAGCCTCCCGAGTAGCTGGGACTATAGGTGGGCGCC<br>ACCCCACCTGGCTAAATCTCTTTTTAACTTTTGTAGAGATAGGCATCTCGCTATGTT<br>GCCTAGGCTGGGCTGGAACTCCTGGGCTCAAGTGCTCCTCCTGCCTTGGCCTCCCAA<br>AGCGCTAGGATTACAGATGTGAGCCACCGCGCCCACCCTGAACCTTACTTTTTTTGC<br>TCAGTTTCTGGTAATTCAGAGAATGCCTCCTGAGTTGTTCTACACCCACCTCATATT<br>CCATGGGAGGGCTGTACAGGGCTTTTTTAACGAGGCCTCTAAGGACAGGCATTTGTA<br>TCCTTTCCAGCCTTTCACTATTACAATGTTGTAGTGAATAACTTTACACACTGTCAT<br>TTATTTTACTTTTTTTTTTTTTTATTTTAGAGAAAGGAATCTTGCCATCTTGCCCAG<br>GCTGGTCTCAAATTCCTGGGCCCAAACAATCCTCCCGCCTTGGCCTCCTAAAGTACT<br>GGGATTTATAGGCATAAGCCACCGTGCCTGGCCAATGCACACTGTCATTTAGCTCAT<br>GTTAACACCTGAGTGTAGGACACACTCCTGGAGGTGGAATTGCTGGGCCAAAGAGTA<br>TGTTTCTTGTCATTGTGATAGATATTGACAAATGAACCCTCACAGAAGTTGTGCTGA<br>GTTCTGTTCCCACCAGCGACGTAGGCGATGACCTTTTTCTGGAGGGAGGGGGCATCC<br>TTGGAGTCCACAGAGCCAGGAATGGAGAGTGGGCCCAGAATTTTGGTATAGGTGTTG<br>TATAAACTTATAGTAAGGTTAAGAAAACCGCAACTATCCTTATCAGAGACTTGGCGG<br>GGGGCAGGGTATGATGGAGATCATAAGGAGGCTAAAACACTCCACACCCTCCCTCTG<br>CATTGCTCCTGCACGGGAGTCGGGAATCTTTTCAGGTTGATACGATCTCACCTTGAG<br>GAGCTGTGAGGTCCCAGAAGCCTCTGGGTTGCAGATTGCTTGGGGTGAAAATGTCTG<br>TGCTACTGAAATCTAACTTTTTACAAAAAATTACGGGCTGGGCGCAGTGGCTCACGC<br>CTGTAATCCCAGCACTTTGGGAGGCTGCAGCGGGTGGATCACTTGAGGTAAGGAGTT<br>CAAGACCAGACCATAGTGAAACCGTGTCTCTACAAAAAAAATTAGCCAGGTGTGGTG<br>GTGCATGCTTGTAATCCCAGCTACTCAGAAGGCTGAGGTGGGAGAATCCCTTGAACC<br>CGGGAAGTGGAGGCTGGAGTAAACCATGATCGAGTTACTGCACTCCAGCCTGGGTGA<br>CAAGAGTGAGACTCTGTCTCCAAAAAAAAAAAAAAAAAAAAAAAAAACTGGATTGCCT<br>GGCTCTACTCCGGGCACAGCATGCAGGCCCAGTTCTGCTGCTCTGCTGTTTGTTCTG<br>CTTTCCTCCACATATTGGCATCACCCTCTGGTGCCAAGATGGCTGCTGCATTCCAGG<br>CATCACATCCAGACTCAGACCCAGAGAAGCTGCCCATCCCTACCTGGGTGAGCCTTT<br>GTAGGAACGAGAAACCGCATCCAGCAGCAGAAACCTCACCCAGCAGCGTCTTTTCCG<br>GTCTCATTCACCAGCGCCGCCCACCGCTCAACCAATCCCTGGCCAAAAGAATGGGAC<br>CGCCTGGAAGGCTGGACCAAACAGGACCTGCCCTCTGGGGCTGGGGAGAGGCCCAGA<br>TGAAGGCTGCAGGACAGGATGGACTCCTAGACCTCTGTTACCAGCAGTGACTACCTC<br>TGTCTGGGTGGTTGGAACATGTTTGAATTTTATTCTAAGTACTGTCTACAAGTTCTG<br>CAATAAACCTTGACTCTTCTTTTAATAATGCAAAA (SEQ ID NO: 33)<br><br>>NP_006496.4 poliovirus receptor isoform alpha precursor<br>[*Homo sapiens*]<br>MARAMAAAWPLLLVALLVLSWPPPGTGDVVVQAPTQVPGFLGDSVTLPCYLQVPNME<br>VTHVSQLTWARHGESGSMAVFHQTQGPSYSESKRLEFVAARLGAELRNASLRMFGLR<br>VEDEGNYTCLFVTFPQGSRSVDIWLRVLAKPQNTAEVQKVQLTGEPVPMARCVSTGG<br>RPPAQITWHSDLGGMPNTSQVPGFLSGTVTVTSLWILVPSSQVDGKNVTCKVEHESF<br>EKPQLLTVNLTVYYPPEVSISGYDNNWYLGQNEATLTCDARSNPEPTGYNWSTTMGP<br>LPPFAVAQGAQLLIRPVDKPINTTLICNVTNALGARQAELTVQVKEGPPSEHSGMSR<br>NAIIFLVLGILVFLILLGIGIYFYWSKCSREVLWHCHLCPSSTEHASASANGHVSYS<br>AVSRENSSSQDPQTEGTR (SEQ ID NO: 34) |
| Mouse PVR (CD155) | >NM_027514.2 *Mus musculus* poliovirus receptor (Pvr), mRNA<br>AGGCGGCACCCGCTTAGCTGAGATTCCAGCACTTGACTTCAGGGTTTCGGAGAGATA<br>AGGCGCTTGGCCGTTACTAACTGGACTACAAAGAGCTGGATCGGACCGGAACCACAT<br>GGCTCAACTCGCCCGAGCCACCCGCTCCCCGCTGTCATGGCTGCTGCTGCTGTTCTG<br>CTATGCACTCCGGAAAGCGGGTGGGGATATACGTGTGCTGGTGCCCTACAATTCGAC<br>AGGCGTCTTGGGAGGGTCGACCACCTTGCACTGTAGTCTGACTTCTAATGAGAATGT<br>GACTATCACTCAAATAACCTGGATGAAGAAGGATTCAGGTGGATCCCACGCTCTTGT<br>GGCTGTCTTCCACCCCAAGAAGGGGCCCAACATCAAAGAGCCAGAGAGGGTGAAATT<br>CTTGGCTGCCCAACAGGATCTGAGGAACGCATCTCTGGCCATCTCGAACTTAAGTGT<br>AGAAGACGAAGGCATCTATGAATGTCAGATTGCCACATTCCCCAGAGGCAGTAGAAG<br>CACCAATGCCTGGCTGAAGGTGCAAGCCCGACCTAAGAACACTGCAGAGGCCCTGGA<br>GCCCTCTCCCACCTTGATACTGCAGGATGTGGCTAAATGCATCTCTGCCAATGGTCA<br>CCCTCCTGGACGAATCTCTTGGCCCTCGAATGTGAATGGAAGTCACCGTGAAATGAA<br>GGAACCAGGGTCCCAGCCGGGCACCACCACAGTTACCAGCTACCTCTCCATGGTACC<br>TTCTCGCCAGGCAGACGGCAAGAACATCACCTGCACGGTGGAGCATGAAAGCTTACA<br>GGAGCTGGACCAGCTGCTGGTGACCCTTTCCCAACCCATCCCACCTGAAAACGTGTC<br>CATCTCTGGCTATGACGGCAACTGGTATGTTGGCCTCACTAACTTGACCCTGACCTG<br>TGAAGCTCACAGCAAACCAGCGCCTGACATGGCTGGATATAACTGGAGCACGAACAC<br>GGGTGACTTTCCCAACTCTGTTAAGCGCCAGGGCAATATGCTTCTAATCTCCACCGT<br>AGAGGATGGTCTCAATAACACGGTCATTGTGTGCGAAGTCACCAATGCCCTAGGGTC<br>TGGGCAGGGCCAAGTGCACATCATTGTTAAAGAGAAACCTGAGAATATGCAGCAAAA<br>TACAAGATTACACCTAGGCTACATCTTTCTTATCGTCTTTGTCCTCGCTGTAGTCAT<br>CATCATCGCAGCACTATACACTATACGAAGATGCAGGCATGGTCGTGCTCTGCAGTC<br>CAATCCCTCAGAGAGGGAGAACGTCCAGTATTCATCTGTGAACGGCGACTGTAGACT<br>GAACATGGAGCCAAACAGCACAAGGTGACGGTGCTGGGTAGACAGAACTAAGGAACT<br>TGAAGGCATAGCAACTGGAACCCTACTCTCATAAATGAAGAAGCCTCCAGAGAGACT<br>GGCTGCTCAGTGTGATGAGCATAGCAAGTTTGGGGGGTCTCCCAGGATGCTGCCGAA<br>TTCCACGTTGTCAAAAGGACCCATGGAGGCCAGTGTGTTGGCTCACTCTTGACATCT<br>CAGCAAGCTGGGGGGGGGGGGAGCATAAAGCAAGGTTGAGTCTAGCTTGGGCTA<br>TAGAGCAAAGCCCTGTCCATACACAAACAAGCTAAGGGGCTTTGAGACGGTCAGAAA |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | CTGAAGTCTTGCTTTGGGTAAGGTAAATCCTCTACCGCATGTATGTGCTAGACTTGA<br>AAGACTTCCACACAGACCTCTTTATAAGTTGACTCCATTGGGGCTATCCCCTCCTCT<br>CTGGACAAGGTCTCTGTATGTAGCCAAGGCTAGGCTCAAACTCACAGAGATATGTCT<br>GCTTCTACCTCCCCAGTGCTAGAGTTGAAAGTATTTGTGCCACTGCACTTTTCTAGG<br>TCTTCTTTTAATGAAGTAAAGTATATATTTATAAAAAGCTATTTAGTTATATATATA<br>TATATTTTTGAGACTATTTCATAGAGCCCAAGCTAACCTCAAACTTACTATGTAGCC<br>AAGAGTGATGGTAAACTAATTTATTTTAATTTATTTGTCTTCAATTTTAACCATCAC<br>CCAACCCCTGCTCCCTTCCATATCTTCTTTCAATCCATTTCATTGTCTTTTTCTTCC<br>CAGACACTATTCTGACTTACGTCTCCATTACAAACATTTTATTGAACTACATAAAAA<br>TGTGTGAACCACAAAAAAAAAATGTATTTGTCAAAATTGTAGTTGTCTTTCTGAGGC<br>TGACCTGAGTTCTCTGATACCATTCTCTCCAGTTGTATCCAGTTTCCTGTAAACAAT<br>GTGACTTTGTTTTCTCAGTAGCTAAAACATCCCAATTATGTGAGTGTACACTTTCT<br>TTACTCATTCCTCTGTGGGCCACCAGCTGGGTTGGTTCCATATCTGAGCTATTGTGC<br>ATGGAATTGTCTCTGTGGTGGGTTTAGTAAACTCCCAGGAATGCCTGTACATGTTTG<br>TAGAGGCCAGAAGAAGGCACAAAATCTTGAGCCAGGCTTACATGCACTTGTGAGTAG<br>CCCCACATAGGTGCTAAGAACCCAGTTCAGGTCCTCTGCTGTGGGATGGTGGGCTGT<br>GCACAGAAAGCCTGGTCCCGGTCTAGCAAAGGTCTGGAACTCCGGAGCCGGTGGGCT<br>GTGATTTACACCAGCATGGGATGGAAGGAGTTGGACCTCGCCTCCTGGGCACCTGGC<br>TCCTGTCACATAGCTACAGCCTCCCACAGCCCCCTATAGGGAGGTATGCAGCATCA<br>ATCACATAGTAGCTGCACTAAGCCCTCCCACATGCAAATAAGGTTTCCCCAAACTCT<br>CAGTCCAAGCCAATGAAAAGTACCTGCTGTCAAACCCTAAATCATCCCCAAAACTCT<br>GTAAGTCCTATCAGGGAATAAAATGTGTGTGAAAACTAAAAAAAAAAAAAAA (SEQ ID NO: 35)<br><br>>NP_081790.1 poliovirus receptor precursor [*Mus musculus*]<br>MAQLARATRSPLSWLLLLFCYALRKAGGDIRVLVPYNSTGVLGGSTTLHCSLTSNEN<br>VTITQITWMKKDSGGSHALVAVFHPKKGPNIKEPERVKFLAAQQDLRNASLAISNLS<br>VEDEGIYECQIATFPRGSRSTNAWLKVQARPKNTAEALEPSPTLILQDVAKCISANG<br>HPPGRISWPSNVNGSHREMKEPGSQPGTTTVTSYLSMVPSRQADGKNITCTVEHESL<br>QELDQLLVTLSQPYPPENVSISGYDGNWYVGLTNLTLTCEAHSKPAPDMAGYNWSTN<br>TGDFPNSVKRQGNMLLISTVEDGLNNTVIVCEVTNALGSGQGQVHIIVKEKPENMQQ<br>NTRLHLGYIFLIVFVLAVVIIAALYTIRRCRHGRALQSNPSERENVQYSSVNGDCR<br>LNMEPNSTR (SEQ ID NO: 36) |
| Human Nectin-2 (CD112) isoform alpha | >NM_002856.3 *Homo sapiens* nectin cell adhesion molecule 2 (NECTIN2), transcript variant alpha, mRNA<br>GTGACGTCAGCGGGTTCGAACCGCCGGAGCTGAGCGAGAGGCCGGGGGTGCCGAGCC<br>GGGCGGGGAGAGCTGGGCCGGGAGAGCAGAACAGGGAGGCTAGAGCGCAGCGGGAAC<br>CGGCCCGGAGCCGGAGCCGGAGCCCCACAGGCACCTACTAAACCGCCCAGCCGATCG<br>GCCCCCACAGAGTGGCCGCGGGCCTCCGGCCGGGCCCAGTCCCCTCCCGGGCCCTC<br>CATGGCCCGGGCCGCTGCCCTCCTGCCGTCGAGATCGCCGCCGACGCCGCTGCTGTG<br>GCCGCTGCTGCTGCTGCTGCTCCTGGAAACCGGAGCCCAGGATGTGCGAGTTCAAGT<br>GCTACCCGAGGTGCGAGGCCAGCTCGGGGGCACCGTGGAGCTGCCGTGCCACCTGCT<br>GCCACCTGTTCCTGGACTGTACATCTCCCTGGTGACCTGGCAGCGCCCAGATGCACC<br>TGCGAACCACCAGAATGTGGCCGCCTTCCACCCTAAGATGGGTCCCAGCTTCCCCAG<br>CCCGAAGCCTGGCAGCGAGCGGCTGTCCTTCGTCTCTGCCAGCAGAGCACTGGGCA<br>AGACACAGAGGCAGAGCTCCAGGACGCCACGCTGGCCCTCCACGGGCTCACGGTGGA<br>GGACGAGGGCAACTACACTTGCGAGTTTGCCACCTTCCCCAAGGGGTCCGTCCGAGG<br>GATGACCTGGCTCAGAGTCATAGCCAAGCCCAAGAACCAAGCTGAGGCCCAGAAGGT<br>CACGTTCAGCCAGGACCCTACGACAGTGGCCCTCTGCATCTCCAAAGAGGGCCGCCC<br>ACCTGCCCGGATCTCCTGGCTCTCATCCCTGGACTGGGAAGCCAAAGAGACTCAGGT<br>GTCAGGGACCCTGGCCGGAACTGTCACTGTCACCAGCCGCTTCACCTTGGTGCCCTC<br>GGGCCGAGCAGATGGTGTCACGGTCACCTGCAAAGTGGAGCATGAGAGCTTCGAGGA<br>ACCAGCCCTGATACCTGTGACCCTCTCTGTACGCTACCCTCCTGAAGTGTCCATCTC<br>CGGCTATGATGACAACTGGTACCTCGGCCGTACTGATGCCACCCTGAGCTGTGACGT<br>CCGCAGCAACCCAGAGCCCACGGGCTATGACTGGAGCACGACCTCAGGCACCTTCCC<br>GACCTCCGCAGTGGCCCAGGGCTCCCAGCTGGTCATCCACGCAGTGGACAGTCTGTT<br>CAATACCACCTTCGTCTGCACAGTCACCAATGCCGTGGGCATGGGCCGCGCTGAGCA<br>GGTCATCTTTGTCCGAGAAACCCCCAGGGCCTCGCCCCGAGATGTGGGCCCGCTGGT<br>GTGGGGGCCGTGGGGGGGACACTGCTGGTGCTGCTGCTTCTGGCTGGGGGGTCCTT<br>GGCCTTCATCCTGCTGAGGGTGAGGAGGAGGAGGAAGAGCCCTGGAGGAGCAGGAGG<br>AGGAGCCAGTGGCGACGGGGGATTCTACGATCCGAAAGCTCAGGTGTTGGGAAATGG<br>GGACCCCGTCTTCTGGACACCAGTAGTCCCTGGTCCCATGGAACCAGATGGCAAGGA<br>TGAGGAGGAGGAGGAGGAGGAAGAGAAGGCAGAGAAGGCCTCATGTTGCCTCCACC<br>CCCAGCACTCGAGGATGACATGGAGTCCCAGCTGGACGGCTCCTCATCTCACGGCG<br>GGCAGTTTATGTGTGACCTGGACACAGACAGAGACAGAGCCAGGCCCGGCCCTCCCG<br>CCCCCGACCTGACCACGCCGGCCTAGGGTTCCAGACTGGTTGGACTTGTTCGTCTGG<br>ACGACACTGGAGTGGAACACTGCCTCCCACTTTCTTGGGACTTGAGGGAGGTGGAA<br>CAGCACACTGGACTTCTCCCGTCTCTAGGGCTGCATGGGAGCCCGGGGAGCTGAGT<br>AGTGGGGATCCAGAGAGGACCCCCGCCCCAGAGACTTGGTTTTGGCTCCAGCCTTC<br>CCCTGGCCCCGTGACACTCAGGAGTTAATAAATGCCTTGGAGGAAAACA (SEQ ID NO: 37) |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | >NP_002847.1 nectin-2 isoform alpha precursor [Homo sapiens]<br>MARAAALLPSRSPPTPLLWPLLLLLLLETGAQDVRVQVLPEVRGQLGGTVELPCHLL<br>PPVPGLYISLVTWQRPDAPANHQNVAAFHPKMGPSFPSPKPGSERLSFVSAKQSTGQ<br>DTEAELQDATLALHGLTVEDEGNYTCEFATFPKGSVRGMTWLRVIAKPKNQAEAQKV<br>TFSQDPTTVALCISKEGRPPARISWLSSLDWEAKETQVSGTLAGTVTVTSRFTLVPS<br>GRADGVTVTCKVEHESFEEPALIPVTLSVRYPPEVSISGYDDNWYLGRTDATLSCDV<br>RSNPEPTGYDWSTTSGTFPTSAVAQGSQLVIHAVDSLFNTTFVCTVTNAVGMGRAEQ<br>VIFVRETPRASPRDVGPLVWGAVGGTLLVLLLLAGGSLAFILLRVRRRRKSPGGAGG<br>GASGDGGFYDPKAQVLGNGDPVFWTPVVPGPMEPDGKDEEEEEEEEKAEKGLMLPPP<br>PALEDDMESQLDGSLISRRAVYV (SEQ ID NO: 38) |
| Mouse Nectin-2 (CD112) isoform alpha | >NM_001159724.1 Mus musculus nectin cell adhesion molecule 2 (Nectin2), transcript variant 2, mRNA<br>GAGCCCTAGGATCGGCTTGGCGAAGAGGGGCGGGGCCTGTGACGTCATGAGTCCGGC<br>CCGCTGGAGCTAAGCGAGGGGCCGGGGGGCGCGGATCCTGAGAGCCAGGCGAGGGAA<br>AGCTGGGCCGAACGAACTGATCCGGGGAGCCGTGAGCGGCGGAAGCCGGCCTGGAGC<br>CGGACACTTCAGACCCCTGACTGCCCTCCCAGCCGATCGGTACACGAAGAGTGGTCC<br>CTAGGCACCCCCTGCCCGGGCCCAGTCCCTCCCCGGGCCCCCCATGCCCGGGCCGC<br>AGTCCTCCCGCCGTCCAGATTGTCACCGACGCTGCCGTTGTTGCCGCTGCTACTGCT<br>CCTGCTTCAGGAAACAGGAGCCCAAGATGTGCGGGTACGAGTGCTTCCCGAGGTCCG<br>GGGCCGCTTGGGAGGCACCGTGGAGTTACCGTGCCACCTGCTCCCACCCACGACGGA<br>GCGCGTCTCTCAGGTGACCTGGCAGCGCCTGGATGGCACAGTTGTGGCTGCTTTCCA<br>CCCATCCTTCGGAGTGGATTTCCCCAACTCTCAGTTCAGCAAGGACCGTCTGTCCTT<br>TGTCAGAGCGAGACCAGAAACAAACGCAGACCTGCGGGATGCCACACTGGCCTTCCG<br>GGGACTGAGGGTAGAGGACGAGGGCAATTACACCTGCGAGTTTGCCACGTTTCCCAA<br>CGGTACCCGCAGGGGGTGACCTGGCTCAGAGTCATAGCCCAGCCTGAGAACCACGC<br>TGAAGCCCAGGAGGTCACAATTGGCCCCCAGTCGGTGGCTGTAGCCCGCTGTGTCTC<br>CACTGGGGGCCGCCCCCTGCCCGAATCACCTGGATCTCATCTCTGGGTGGAGAGGC<br>CAAAGATACTCAGGAGCCAGGGATACAGGCTGGCACCGTCACTATCATCAGCCGATA<br>CTCCTTGGTGCCCGTGGGCCGAGCGGATGGCGTCAAGGTCACGTGTAGAGTGGAACA<br>CGAGAGCTTCGAAGAGCCGATCCTGCTGCCAGTGACCCTCTCTGTGCGCTACCCTCC<br>AGAAGTATCCATCTCCGGCTATGATGACAACTGGTACCTTGGCCGCAGTGAGGCCAT<br>ACTGACCTGTGATGTACGAAGCAACCCAGAGCCCACAGACTATGACTGGAGCACGAC<br>CTCGGGCGTCTTCCCAGCCTCTGCAGTGGCCCAGGGCTCTCAGCTGCTTGTCCACTC<br>TGTGGATCGAATGGTCAACACTACCTTCATCTGTACAGCCACCAACGCTGTGGGAC<br>AGGCCGTGCTGAGCAGGTCATCCTGGTGCGAGACACCCCCAGGCCTCCCGAGATGT<br>GGGTCCGCTGGTGTGGGGGCCGTGGGGGGAACATTGCTGGTGCTACTCCTGGCTGG<br>GGGGTTCCTGGCCTTGATCCTGCTGAGGGGGAGGAGGAGGCGGAAGAGCCCTGGAGG<br>AGGAGGAAATGATGGCGACAGAGGATCCTACGATCCAAAGACTCAGGTGTTTGGGAA<br>CGGGGGTCCTGTCTTCTGGAGGTCAGCATCCCCTGAGCCCATGAGGCCAGATGGCAG<br>GGAGGAAGATGAGGAGGAGGAGGAAGAAATGAAGGCAGAGGAAGGTCTCATGCTACC<br>TCCACACGAGTCACCTAAGGACGACATGGAGTCCCATCTGGATGGCTCCCTCATCTC<br>TCGGCGGGCAGTTTACGTGTGACCCTACGATATAGACACTGGACACATGGAAACACC<br>AAGTTCCACCCTCACTGCCAACCACACCAATGCCAGCCAGCAACGATGGCTAGGGAC<br>CGGTTGGACTGGTTCTTCTGGGGCACACTGGAGTTGGAAGGGCACCGCCCCTGCTTT<br>CAGGATAGAGGACAAGTGGAACCACACAGACTCCTATCTTTAGGGCCTCATGGAGTA<br>GGGGACCCCAGGAGCGCCATGGTGCACACTCAGGACTCCTCAGAGCTTGCTTTCGGC<br>CCCAGCCTAGCCCTGGCCCCGAAACACTCAGGAGCTAATAAATGCCTTGTCGGAAAA<br>AAAAAAAAAAAAAA (SEQ ID NO: 39) |
| | >NP_001153196.1 nectin-2 isoform 2 precursor [Mus musculus]<br>MARAAVLPPSRLSPTLPLLPLLLLLLQETGAQDVRVRVLPEVRGRLGGTVELPCHLL<br>PPTTERVSQVTWQRLDGTVVAAFHPSFGVDFPNSQFSKDRLSFVRARPETNADLRDA<br>TLAFRGLRVEDEGNYTCEFATFPNGTRRGVTWLRVIAQPENHAEAQKVTIGPQSVAV<br>ARCVSTGGRPPARITWISSLGGEAKDTQEPGIQAGTVTIISRYSLVPVGRADGVKVT<br>CRVEHESFEEPILLPVTLSVRYPPEVSISGYDDNWYLGRSEAILTCDVRSNPEPTDY<br>DWSTTSGVFPASAVAQGSQLLVHSVDRMVNTTFICTATNAVGTGRAEQVILVRDTPQ<br>ASRDVGPLVWGAVGGTLLVLLLAGGFLALILLRGRRRRKSPGGGGNDGDRGSYDPKT<br>QVFGNGGPVFWRSASPEPMRPDGREEDEEEEEMKAEEGLMLPPHESPKDDMESHLD<br>GSLISRRAVYV (SEQ ID NO: 40) |
| Human Nectin-2 (CD112) isoform delta | >NM_001042724.2 Homo sapiens nectin cell adhesion molecule 2 (NECTIN2), transcript variant delta, mRNA<br>GTGACGTCAGCGGGTTCGAACCGCCGGAGCTGAGCGAGAGGCCGGGGGTGCCGAGCC<br>GGGCGGGAGAGCTGGGCCGGGAGAGCAGAACAGGGAGGCTAGAGCGCAGCGGGAAC<br>CGGCCCGGAGCCGGAGCCGGAGCCCCACAGGCACCTACTAAACCGCCCAGCCGATCG<br>GCCCCCACAGAGTGGCCCGCGGGCCTCCGGCCGGGCCCCAGTCCCTCTCCCGGCCCTC<br>CATGGCCCGGGCCGCTGCCCTCCTGCCGTCGAGATCGCCGCCGACGCCGCTGCTGTG<br>GCCGCTGCTGCTGCTGCTGCTCCTGGAAACCGGAGCCCAGGATGTGCGAGTTCAAGT<br>GCTACCCGAGGTGCGAGGCCAGCTCGGGGCACCGTGGAGCTGCCGTGCCACCTGCT<br>GCCACCTGTTCCTGGACTGTACATCTCCCTGGTGACCTGGCAGCGCCCAGATGCACC<br>TGCGAACCACCAGAATGTGGCCGCCTTCCACCCTAAGATGGGTCCCAGCTTCCCCAG |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | CCCGAAGCCTGGCAGCGAGCGGCTGTCCTTCGTCTCTGCCAAGCAGAGCACTGGGCA<br>AGACACAGAGGCAGAGCTCCAGGACGCCACGCTGGCCCTCCACGGGCTCACGGTGGA<br>GGACGAGGGCAACTACACTTGCGAGTTTGCCACCTTCCCCAAGGGGTCCGTCCGAGG<br>GATGACCTGGCTCAGAGTCATAGCCAAGCCCAAGAACCAAGCTGAGGCCCAGAAGGT<br>CACGTTCAGCCAGGACCCTACGACAGTGGCCCTCTGCATCTCCAAAGAGGGCCGCCC<br>ACCTGCCCGGATCTCCTGGCTCTCATCCCTGGACTGGGAAGCCAAAGAGACTCAGGT<br>GTCAGGGACCCTGGCCGGAACTGTCACTGTCACCAGCCGCTTCACCTTGGTGCCCTC<br>GGGCCGAGCAGATGGTGTCACGGTCACCTGCAAAGTGGAGCATGAGAGCTTCGAGGA<br>ACCAGCCCTGATACCTGTGACCCTCTCTGTACGCTACCCTCCTGAAGTGTCCATCTC<br>CGGCTATGATGACAACTGGTACCTCGGCCGTACTGATGCCACCCTGAGCTGTGACGT<br>CCGCAGCAACCCAGAGCCCACGGGCTATGACTGGAGCACGACCTCAGGCACCTTCCC<br>GACCTCCGCAGTGGCCCAGGGCTCCCAGCTGGTCATCCACGCAGTGGACAGTCTGTT<br>CAATACCACCTTCGTCTGCACAGTCACCAATGCCGTGGGCATGGGCCGCGCTGAGCA<br>GGTCATCTTTGTCCGAGAGACCCCCAACACAGCAGGCGCAGGGGCCACAGGCGGCAT<br>CATCGGGGGCATCATCGCCGCCATCATTGCTACTGCTGTGGCTGCCACGGGCATCCT<br>TATCTGCCGGCAGCAGCGGAAGGAGCAGACGCTGCAGGGGGCAGAGGAGGACGAAGA<br>CCTGGAGGGACCTCCCTCCTACAAGCCACCGACCCCAAAAGCGAAGCTGGAGGCACA<br>GGAGATGCCCTCCCAGCTCTTCACTCTGGGGGCCTCGGAGCACAGCCCACTCAAGAC<br>CCCCTACTTTGATGCTGGCGCCTCATGCACTGAGCAGGAAATGCCTCGATACCATGA<br>GCTGCCCACCTTGGAAGAACGGTCAGGACCCTTGCACCCTGGAGCCACAAGCCTGGG<br>GTCCCCCATCCCGGTGCCTCCAGGGCCACCTGCTGTGGAAGACGTTTCCCTGGATCT<br>AGAGGATGAGGAGGGGGAGGAGGAGGAAGAGTATCTGGACAAGATCAACCCCATCTA<br>TGATGCTCTGTCCTATAGCAGCCCCTCTGATTCCTACCAGGGCAAAGGCTTTGTCAT<br>GTCCCGGGCCATGTATGTGTGAGCTGCCATGCGCCTGGCGTCTCACATCTCACCTGT<br>TGATCCCTTAGCTTTCTTGCCAAGGATCTAGTGCCCCCTGACCTCTGGCCAGGCCAC<br>TGTCAGTTAACACATATGCATTCCATTTGTGATGTCTACCTTGGTGGCTCCACTATG<br>ACCCCTAACCCATGAGCCCAGAGAAATTCACCGTGATAATGGAATCCTGGCAACCTT<br>ATCTCATGAGGCAGGAGGTGGGGAAGGTGCTTCTGCACAACCTCTGATCCCAAGGAC<br>TCCTCTCCCAGACTGTGACCTTAGACCATACCTCTCACCCCCCAATGCCTCGACTCC<br>CCCAAAATCACAAAGAAGACCCTAGACCTATAATTTGTCTTCAGGTAGTAAATTCCC<br>AATAGGTCTGCTGGAGTGGGCGCTGAGGGCTCCCTGCTGCTCAGACCTGAGCCCTCC<br>AGGCAGCAGGGTCCCACTTACCCCCTCCCCACCCTGTTCCCCAAAGGTGGGAAAGAG<br>GGGATTCCCCAGCCCAAGGCAGGGTTTTCCCAGCACCCTCCTGTAAGCAGAAGTCTC<br>AGGGTCCAGACCCTTCCCTGAGCCCCCACCCCCACCCCAATTCCTGCCTACCAAGCA<br>AGCAGCCCAGCCTAGGGTCAGACAGGGTGAGCCTCATACAGACTGTGCCTTGATGG<br>CCCCAGCCTTGGGAGAAGAATTTACTGTTAACCTGGAAGACTACTGAATCATTTTAC<br>CCTTGCCCAGTGGAATAGGACCTAAACATCCCCCTTCCGGGGAAAGTGGGTCATCTG<br>AATTGGGGGTAGCAATTGATACTGTTTTGTAAACTACATTTCCTACAAAATATGAAT<br>TTATACTTTGA (SEQ ID NO: 41)<br><br>>NP_001036189.1 nectin-2 isoform delta precursor [*Homo sapiens*]<br>MARAAALLPSRSPPTPLLWPLLLLLLLETGAQDVRVQVLPEVRGQLGGTVELPCHLL<br>PPVPGLYISLVTWQRPDAPANHQNVAAFHPKMGPSFPSPKPGSERLSFVSAKQSTGQ<br>DTEAELQDATLALHGLTVEDEGNYTCEFATFPKGSVRGMTWLRVIAKPKNQAEAQKV<br>TFSQDPTTVALCISKEGRPPARISWLSSLDWEAKETQVSGTLAGTVTVTSRFTLVPS<br>GRADGVTVTCKVEHESFEEPALIPVTLSVRYPPEVSISGYDDNWYLGRTDATLSCDV<br>RSNPEPTGYDWSTTSGTFPTSAVAQGSQLVIHAVDSLFNTTFVCTVTNAVGMGRAEQ<br>VIFVRETPNTAGAGATGGIIGGIIAAIIATAVAATGILICRQQRKEQTLQGAEEDED<br>LEGPPSYKPPTPKAKLEAQEMPSQLFTLGASEHSPLKTPYFDAGASCTEQEMPRYHE<br>LPTLEERSGPLHPGATSLGSPIPVPPGPPAVEDVSLDLEDEEGEEEEEYLDKINPIY<br>DALSYSSPSDSYQGKGFVMSRAMYV (SEQ ID NO: 42) |
| Mouse Nectin-2 (CD112) isoform beta | >NM_008990.3 *Mus musculus* nectin cell adhesion molecule 2 (Nectin2), transcript variant 1, mRNA<br>GAGCCCTAGGATCGGCTTGGCGAAGAGGGCGGGGCCTGTGACGTCATGAGTCCGGC<br>CCGCTGGAGCTAAGCGAGGGGCCGGGGGCGCGGATCCTGAGAGCCAGGCGAGGGAA<br>AGCTGGGCCGAACGAACTGATCCGGGGAGCCGTGAGCGGCGGAAGCCGGCCTGGAGC<br>CGGACACTTCAGACCCCTGACTGCCCTCCAGCCGATCGGTACACGAAGAGTGGTCC<br>CTAGGCACCCCTGCCCGGGCCCAGTCCCTCCCCGGGCCCCCCATGGCCCGGCCGC<br>AGTCCTCCCGCCGTCCAGATTGTCACCGACGCTGCCGTTGTTGCCGCTGCTACTGCT<br>CCTGCTTCAGGAAACAGGAGCCCAAGATGTGCGGGTACGAGTGCTTCCCGAGGTCCG<br>GGGCCGCTTGGGAGGCACCGTGGAGTTACCGTGCCACCTGCTCCCACCCACGACGGA<br>GCGCGTCTCAGGTGACCTGGCAGCGCCTGGATGGCACAGTTGTGGCTGCTTTCCA<br>CCCATCCTTCGGAGTGGATTTCCCCAACTCTCAGTTCAGCAAGGACCGTCTGTCCTT<br>TGTCAGAGCGAGACCAGAAACAAACGCAGACCTGCGGGATGCCACACTGGCCTTCCG<br>GGGACTGAGGGTAGAGGACGAGGGCAATTACACCTGCGAGTTTGCCACGTTTCCCAA<br>CGGTACCCGCAGGGGGTGACCTGGCTCAGAGTCATAGCCCAGCCTGAGAACCACGC<br>TGAAGCCCAGGAGGTCACAATTGGCCCCAGTCGGTGGCTGTAGCCCGCTGTGTCTC<br>CACTGGGGCCGCCCCCTGCCCGAATCACCTGGATCTCATCTCTGGGTGGAGAGGC<br>CAAAGATACTCAGGAGCCAGGGATACAGGCTGGCACCGTCACTATCATCAGCCGATA<br>CTCCTTGGTGCCCGTGGGCCGAGCGGATGGCGTCAAGGTCACGTGTAGAGTGGAACA<br>CGAGAGCTTCGAAGAGCCGATCCTGCTGCCAGTGACCCTCTCTGTGCGCTACCCTCC<br>AGAAGTATCCATCTCCGGCTATGATGACAACTGGTACCTTGGCCGCAGTGAGGCCAT<br>ACTGACCTGTGATGTACGAAGCAACCCAGAGCCCACAGACTATGACTGGAGCACGAC |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | CTCGGGCGTCTTCCCAGCCTCTGCAGTGGCCCAGGGCTCTCAGCTGCTTGTCCACTC<br>TGTGGATCGAATGGTCAACACTACCTTCATCTGTACAGCCACCAACGCTGTGGGAC<br>AGGCCGTGCTGAGCAGGTCATCCTGGTGCGAGAGTCACCCAGCACAGCAGGAGCAGG<br>GGCCACTGGTGGCATCATTGGAGGTATTATCGCTGCCATCATCGCCACCGCAGTGGC<br>TGGCACAGGCATCCTCATCTGCCGACAACAGCGGAAGGAGCAGAGGCTTCAAGCTGC<br>GGATGAGGAAGAAGAACTGGAAGGACCTCCCTCCTATAAACCACCCACCCCGAAGGC<br>CAAGCTGGAGGAACCAGAGATGCCCTCTCAACTCTTCACCTTGGGGGCCTCAGAGCA<br>CAGCCCAGTGAAGACGCCATACTTTGATGCTGGTGTCTCTTGTGCTGATCAGGAGAT<br>GCCTCGGTATCACGAGCTGCCCACTCTGGAAGAGCGGTCAGGGCCCCTGCTGTTGGG<br>GGCTACAGGCCTGGGACCTTCTCTTCGGTGCCTCCAGGACCCAATGTTGTGGAGGG<br>GGTTTCCCTGAGTCTCGAAGATGAGGAGGAAGATGATGAGGAGGAAGACTTCCTGGA<br>TAAAATCAACCCTATTTATGATGCCCTGTCCTACCCCAGCCCCTCTGACTCCTACCA<br>GAGCAAAGACTTTTTTGTGTCACGGGCCATGTATGTGTGAGGGAGGCACAGGGGCTC<br>TGACGTCTCACCTTTCACCCTTGACCCATGAGCTTTCCACCAGTAATCTAGGACACT<br>CTGACTTCCAGGCAGACCAGGGACAACTATCACCCATTGCAATCCACCTGTGACTTC<br>TTAGTGACTCCACCATGACGTCCAATCTATGATGTCTGAGGCAGGCAAACCTGCACA<br>ACTGGAAACCTGGAGATTTTTATCTCCCTTGGCAGGGAGCTCACCATATCCTTCTGC<br>ACCACCTGTGACCCCCCCCCCCCCCCAAGGACTCCTAAGACTACGACCCTTTGACC<br>ATGCCACTCAGTATCTCAAGAACCCTTAAAGTCCCAAAGGAATCGGACCTTGCACTT<br>GTCCTCAGGCAATAGAGTCCAACAGATATGCAAGAACGGGATCAGGGGCTCCCTGTT<br>GCTCAGACCTGAGCCCTCCAGGCAGCAGAAGCTCACCTGATCCCTCCCCACCCTGCT<br>CCCCAAAGGTGAAAAGGAGAGGATTCCCCAATGTAAGGTAGGACCTCCCCATCTCCA<br>CCTACTCCTGCAGGCAGGAATCTCAGGTTTCTCACACCCTCTCCTCAGCACCCAGGT<br>TCCTGTCTCAGAGCATGAATTCCAGGTCCAATGCTAGAGGGGAGAACCTAATGCAA<br>GTGTGCCTTGCCACCCCAAGTTTGGGAGACTCTGCTCTTATCCTGAGGACTACTGAA<br>TTCTTTTAACCCCTACCCAGTGAGATGAGAACTACATATCCCTCTTTAGGGGATGGT<br>GTGTGTATGTGTGTGATGGAGAATCTGGGCATCTGGGTTGGGAATTTTATTTTGT<br>AAGCATTTCCTACATAATATGAGTTTCTACTTTGATAAAGTCTTGTGTTTTCTGTG<br>(SEQ ID NO: 43) |
| | >NP_033016.3 nectin-2 isoform 1 precursor [Mus musculus]<br>MARAAVLPPSRLSPTLPLLPLLLLLLQETGAQDVRVRVLPEVRGRLGGTVELPCHLL<br>PPTTERVSQVTWQRLDGTVVAAFHPSFGVDFPNSQFSKDRLSFVRARPETNADLRDA<br>TLAFRGLRVEDEGNYTCEFATFPNGTRRGVTWLRVIAQPENHAEAQEVTIGPQSVAV<br>ARCVSTGGRPPARITWISSLGGEAKDTQEPGIQAGTVTIISRYSLVPVGRADGVKVT<br>CRVEHESFEEPILLPVTLSVRYPPEVSISGYDDNWYLGRSEAILTCDVRSNPEPTDY<br>DWSTTSGVFPASAVAQGSQLLVHSVDRMVNTTFICTATNAVGTGRAEQVILVRESPS<br>TAGAGATGGIIGGIIAAIIATAVAGTGILICRQQRKEQRLQAADEEEELEGPPSYKP<br>PTPKAKLEEPEMPSQLFTLGASEHSPVKTPYFDAGVSCADQEMPRYHELPTLEERSG<br>PLLLGATGLGPSLLVPPGPNVVEGVSLSLEDEEEDDEEEDFLDKINPIYDALSYPSP<br>SDSYQSKDFFVSRAMYV (SEQ ID NO: 44) |
| Human IL-10 | >NM_000572.3 Homo sapiens interleukin 10 (IL10),<br>transcript variant 1, mRNA<br>ACACATCAGGGGCTTGCTCTTGCAAAACCAAACCACAAGACAGACTTGCAAAAGAAG<br>GCATGCACAGCTCAGCACTGCTCTGTTGCCTGGTCCTCCTGACTGGGGTGAGGGCCA<br>GCCCAGGCCAGGGCACCCAGTCTGAGAACAGCTGCACCCACTTCCCAGGCAACCTGC<br>CTAACATGCTTCGAGATCTCCGAGATGCCTTCAGCAGAGTGAAGACTTTCTTTCAAA<br>TGAAGGATCAGCTGGACAACTTGTTGTTAAAGGAGTCCTTGCTGGAGGACTTTAAGG<br>GTTACCTGGGTTGCCAAGCCTTGTCTGAGATGATCCAGTTTTACCTGGAGGAGGTGA<br>TGCCCCAAGCTGAGAACCAAGACCCAGACATCAAGGCGCATGTGAACTCCCTGGGGG<br>AGAACCTGAAGACCCTCAGGCTGAGGCTACGGCGCTGTCATCGATTTCTTCCCTGTG<br>AAAACAAGAGCAAGGCCGTGGAGCAGGTGAAGAATGCCTTTAATAAGCTCCAAGAGA<br>AAGGCATCTACAAAGCCATGAGTGAGTTTGACATCTTCATCAACTACATAGAAGCCT<br>ACATGACAATGAAGATACGAAACTGAGACATCAGGGTGGCGACTCTATAGACTCTAG<br>GACATAAATTAGAGGTCTCCAAAATCGGATCTGGGGCTCTGGGATAGCTGACCCAGC<br>CCCTTGAGAAACCTTATTGTACCTCTCTTATAGAATATTTATTACCTCTGATACCTC<br>AACCCCCATTTCTATTTATTTACTGAGCTTCTCTGTGAACGATTTAGAAAGAAGCCC<br>AATATTATAATTTTTTTCAATATTTATTATTTTCACCTGTTTTTAAGCTGTTTCCAT<br>AGGGTGACACACTATGGTATTTGAGTGTTTTAAGATAAATTATAAGTTACATAAGGG<br>AGGAAAAAAAATGTTCTTTGGGGAGCCAACAGAAGCTTCCATTCCAAGCCTGACCAC<br>GCTTTCTAGCTGTTGAGCTGTTTTCCCTGACCTCCCTCTAATTTATCTTGTCTCTGG<br>GCTTGGGGCTTCCTAACTGCTACAAATACTCTTAGGAAGAGAAACCAGGGAGCCCCT<br>TTGATGATTAATTCACCTTCCAGTGTCTCGGAGGGATTCCCCTAACCTCATTCCCCA<br>ACCACTTCATTCTTGAAAGCTGTGGCCAGCTTGTTATTTATAACAACCTAAATTTGG<br>TTCTAGGCCGGGCGCGGTGGCTCACGCCTGTAATCCCAGCACTTTGGGAGGCTGAGG<br>CGGGTGGATCACTTGAGGTCAGGAGTTCCTAACCAGCCTGGTCAACATGGTGAAACC<br>CCGTCTCTACTAAAAATACAAAAATTAGCCGGGCATGGTGGCGCGCACCTGTAATCC<br>CAGCTACTTGGGAGGCTGAGGCAAGAGAATTGCTTGAACCCAGGAGATGGAAGTTGC<br>AGTGAGCTGATATCATGCCCCTGTACTCCAGCCTGGGTGACAGAGCAAGACTCTGTC<br>TCAAAAAATAAAAATAAAAATAAATTTGGTTCTAATAGAACTCAGTTTTAACTAGAA<br>TTTATTCAATTCCTCTGGGAATGTTACATTGTTTGTCTGTCTTCATAGCAGATTTTA<br>ATTTTGAATAAATAAATGTATCTTATTCACATCA (SEQ ID NO: 45) |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | >NP_000563.1 interleukin-10 isoform 1 precursor [Homo sapiens]<br>MHSSALLCCLVLLTGVRASPGQGTQSENSCTHFPGNLPNMLRDLRDAFSRVKTFFQM<br>KDQLDNLLLKESLLEDFKGYLGCQALSEMIQFYLEEVMPQAENQDPDIKAHVNSLGE<br>NLKTLRLRLRRCHRFLPCENKSKAVEQVKNAFNKLQEKGIYKAMSEFDIFINYIEAY<br>MTMKIRN (SEQ ID NO: 46) |
| Mouse IL-10 | >NM_010548.2 Mus musculus interleukin 10 (Il10), mRNA<br>ACATTTAGAGACTTGCTCTTGCACTACCAAAGCCACAAGGCAGCCTTGCAGAAAAGA<br>GAGCTCCATCATGCCTGGCTCAGCACTGCTATGCTGCCTGCTCTTACTGACTGGCAT<br>GAGGATCAGCAGGGGCCAGTACAGCCGGGAAGACAATAACTGCACCCACTTCCCAGT<br>CGGCCAGAGCCACATGCTCCTAGAGCTGCGGACTGCCTTCAGCCAGGTGAAGACTTT<br>CTTTCAAACAAAGGACCAGCTGGACAACATACTGCTAACCGACTCCTTAATGCAGGA<br>CTTTAAGGGTTACTTGGGTTGCCAAGCCTTATCGGAAATGATCCAGTTTTACCTGGT<br>AGAAGTGATGCCCCAGGCAGAGAAGCATGGCCCAGAAATCAAGGAGCATTTGAATTC<br>CCTGGGTGAGAAGCTGAAGACCCTCAGGATGCGGCTGAGGCGCTGTCATCGATTTCT<br>CCCCTGTGAAAATAAGAGCAAGGCAGTGGAGCAGGTGAAGAGTGATTTTAATAAGCT<br>CCAAGACCAAGGTGTCTACAAGGCCATGAATGAATTTGACATCTTCATCAACTGCAT<br>AGAAGCATACATGATGATCAAAATGAAAAGCTAAAACACCTGCAGTGTGTATTGAGT<br>CTGCTGGACTCCAGGACCTAGACAGAGCTCTCTAAATCTGATCCAGGGATCTTAGCT<br>AACGGAAACAACTCCTTGGAAAACCTCGTTTGTACCTCTCTCCGAAATATTTATTAC<br>CTCTGATACCTCAGTTCCCATTCTATTTATTCACTGAGCTTCTCTGTGAACTATTTA<br>GAAAGAAGCCCAATATTATAATTTTACAGTATTTATTATTTTTAACCTGTGTTTAAG<br>CTGTTTCCATTGGGGACACTTTATAGTATTTAAAGGGAGATTATATTATATGATGGG<br>AGGGGTTCTTCCTTGGGAAGCAATTGAAGCTTCTATTCTAAGGCTGGCCACACTTGA<br>GAGCTGCAGGGCCCTTTGCTATGGTGTCCTTTCAATTGCTCTCATCCCTGAGTTCAG<br>AGCTCCTAAGAGAGTTGTGAAGAAACTCATGGGTCTTGGGAAGAGAAACCAGGGAGA<br>TCCTTTGATGATCATTCCTGCAGCAGCTCAGAGGGTTCCCCTACTGTCATCCCCCAG<br>CCGCTTCATCCCTGAAAACTGTGGCCAGTTTGTTATTTATAACCACCTAAAATTAGT<br>TCTAATAGAACTCATTTTTAACTAGAAGTAATGCAATTCCTCTGGGAATGGTGTATT<br>GTTTGTCTGCCTTTGTAGCAGACTCTAATTTTGAATAAATGGATCTTATTCG (SEQ ID NO: 47) |
| | >NP_034678.1 interleukin-10 precursor [Mus musculus]<br>MPGSALLCCLLLLTGMRISRGQYSREDNNCTHFPVGQSHMLLELRTAFSQVKTFFQT<br>KDQLDNILLTDSLMQDFKGYLGCQALSEMIQFYLVEVMPQAEKHGPEIKEHLNSLGE<br>KLKTLRMRLRRCHRFLPCENKSKAVEQVKSDFNKLQDQGVYKAMNEFDIFINCIEAY<br>MMIKMKS (SEQ ID NO: 48) |
| Human TSG-6 | >NM_007115.3 Homo sapiens TNF alpha induced protein 6 (TNFAIP6), mRNA<br>AGTCACATTTCAGCCACTGCTCTGAGAATTTGTGAGCAGCCCCTAACAGGCTGTTAC<br>TTCACTACAACTGACGATATGATCATCTTAATTTACTTATTTCTCTTGCTATGGGAA<br>GACACTCAAGGATGGGGATTCAAGGATGGAATTTTTCATAACTCCATATGGCTTGAA<br>CGAGCAGCCGGTGTGTACCACAGAGAAGCACGGTCTGGCAAATACAAGCTCACCTAC<br>GCAGAAGCTAAGGCGGTGTGTGAATTTGAAGGCGGCCATCTCGCAACTTACAAGCAG<br>CTAGAGGCAGCCAGAAAAATTGGATTTCATGTCTGTGCTGCTGGATGGATGGCTAAG<br>GGCAGAGTTGGATACCCCATTGTGAAGCCAGGGCCCAACTGTGGATTTGGAAAAACT<br>GGCATTATTGATTATGGAATCCGTCTCAATAGGAGTGAAAGATGGGATGCCTATTGC<br>TACAACCCACACGCAAAGGAGTGTGGTGGCGTCTTTACAGATCCAAAGCAAATTTTT<br>AAATCTCCAGGCTTCCCAAATGAGTACGAAGATAACCAAATCTGCTACTGGCACATT<br>AGACTCAAGTATGGTCAGCGTATTCACCTGAGTTTTTTAGATTTTGACCTTGAAGAT<br>GACCCAGGTTGCTTGGCTGATTATGTTGAAATATATGACAGTTACGATGATGTCCAT<br>GGCTTTGTGGGAAGATACTGTGGAGATGAGCTTCCAGATGACATCATCAGTACAGGA<br>AATGTCATGACCTTGAAGTTTCTAAGTGATGCTTCAGTGACAGCTGGAGGTTTCCAA<br>ATCAAATATGTTGCAATGGATCCTGTATCCAAATCCAGTCAAGGAAAAAATACAAGT<br>ACTACTTCTACTGGAAATAAAAACTTTTTAGCTGGAAGATTTAGCCACTTATAAAAA<br>AAAAAAAAAGGATGATCAAAACACACAGTGTTTATGTTGAATCTTTTGGAACTCCT<br>TTGATCTCACTGTTATTATTAACATTTATTTATTATTTTTCTAAATGTGAAAGCAAT<br>ACATAATTTAGGGAAAATTGGAAAATATAGGAAACTTTAAACGAGAAAATGAAACCT<br>CTCATAATCCCACTGCATAGAAATAACAAGCGTTAACATTTTCATATTTTTTTCTTT<br>CAGTCATTTTTCTATTTGTGGTATATGTATATATGTACCTATATGTATTTGCATTTG<br>AAATTTTGGAATCCTGCTCTATGTACAGTTTTGTATTATACTTTTTAAATCTTGAAC<br>TTTATAAACATTTTCTGAAATCATTGATTATTCTACAAAAACATGATTTTAAACAGC<br>TGTAAAATATTCTATGATATGAATGTTTTATGCATTATTTAAGCCTGTCTCTATTGT<br>TGGAATTTCAGGTCATTTTCATAAATATTGTTGCAATAAATATCCTTGAACACACAA<br>AAAAAAAAAAAAA (SEQ ID NO: 49) |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | >NP_009046.2 tumor necrosis factor-inducible gene 6 protein precursor [Homo sapiens]<br>MIILIYLFLLLWEDTQGWGFKDGIFHNSIWLERAAGVYHREARSGKYKLTYAEAKAV<br>CEFEGGHLATYKQLEAARKIGFHVCAAGWMAKGRVGYPIVKPGPNCGFGKTGIIDYG<br>IRLNRSERWDAYCYNPHAKECGGVFTDPKQIFKSPGFPNEYEDNQICYWHIRLKYGQ<br>RIHLSFLDFDLEDDPGCLADYVEIYDSYDDVHGFVGRYCGDELPDDIISTGNVMTLK<br>FLSDASVTAGGFQIKYVAMDPVSKSSQGKNTSTTSTGNKNFLAGRFSHL (SEQ ID NO: 50) |
| Mouse TSG-6 | >NM_009398.2 Mus musculus tumor necrosis factor alpha induced protein 6 (Tnfaip6), mRNA<br>CCGCTGCTCTGAGAATTTCGTGTGGGCAGCCCCGACATTGTAACCGGCTCTGCAACC<br>GAAGAGATGGTCGTCCTCCTTTGCTTATGCGTCTTGCTGTGGGAAGAGGCTCACGGA<br>TGGGGATTCAAGAACGGGATCTTTCATAACTCCATATGGCTTGAACAAGCAGCGGGC<br>GTATACCACAGAGAAGCTCGGGCTGGCAGATACAAGCTCACCTACGCCGAAGCCAAG<br>GCCGTATGTGAATTTGAAGGTGGTCGTCTCGCAACCTACAAGCAGCTAGAGGCAGCC<br>AGAAAAATTGGATTCCATGTCTGTGCTGCTGGATGGATGGCCAAGGGTAGAGTCGGA<br>TACCCCATTGTGAAACCTGGGCCCAACTGTGGATTTGGGAAAACGGGTATCATCGAT<br>TATGGAATCCGGCTCAACAGGAGTGAGCGATGGGATGCCTATTGCTACAACCCACAT<br>GCAAAGGAGTGTGGTGGTGTCTTCACAGATCCGAAGCGAATTTTTAAATCCCCGGGC<br>TTCCCAAATGAGTACGATGACAACCAGGTCTGCTACTGGCACATTCGGCTCAAGTAC<br>GGTCAGCGAATTCACCTGAGCTTTTTGGACTTTGACCTTGAACATGATCCAGGCTGC<br>TTGGCTGACTATGTAGAAATCTATGACAGTTATGATGACGTCCACGGCTTTGTAGGA<br>AGATACTGTGGTGATGAACTTCCAGAAGACATCATTAGCACAGGAAATGTCATGACC<br>TTGAAGTTTCTGAGTGATGCATCCGTCACGGCTGGAGGCTTCCAGATTAAATACGTC<br>ACAGTGGATCCTGCATCTAAATCCAGTCAAGCCAAAAATACAAGTACTACTGGAAAT<br>AAGAAGTTCTTACCTGGAAGGTTTAGCCATCTATAAAAAATTTTTTTAAAAATGTT<br>CAAAACATCCAGTACAATATTTATATTTGTTTTTGTTGTTGTTGTTGGTTTTTTTTT<br>TTTTATTTTGTTTTGTTTTGTTTTTTTGAGACGGGGTTTCTCTGTATAGCCTTGGCT<br>GTCCTGGAACTCACTTTGAAGACCAGGCTGGCCTCGAACTCAGAAATCCACCTGCCT<br>CCGCCTACCAAGTGCTGGGATTAAAGGCGTCCACCACCACCGCCCGGCTTCAATATT<br>TATATTTGTAGCTCTTGGACCTCGTTTGTTCTCTTTTGTATTTTTATTATTAACATG<br>TATTTATTATTTTTCCAAATGTGAAAGCCATATGTAATTATGTGGAAAATTGACAAA<br>TAAATACAGAGAACTTCAAATGAGTTTTTTTTTTAAATCTCATAATTGTACTACACA<br>GAAATAACTAATGTTAAAGTTTTTAAATGTTTGTCTTTCATTCATTTTTCTACTTGT<br>AGTATATGTACATATGTAACTCTATGATTTGCGTTTGAATTTTGGCATTCTGCCTTT<br>TGTAACCTGATATTTTTAACCTTGACATTGTATAGCTCAAGCACTTCCCAAGATCTC<br>TGAGTTTTCTACAAAATGGGACTTTGTAAATATGATTGTTCCCTGCTTTATTTAAGC<br>TGAATTTATATTAGGATTTAAGGTTGTTTTCATAAATATTGCTGTAATAAATACTTT<br>TGGAT (SEQ ID NO: 51)<br><br>>NP_033424.1 tumor necrosis factor-inducible gene 6 protein precursor [Mus musculus]<br>MVVLLCLCVLLWEEAHGWGFKNGIFHNSIWLEQAAGVYHREARAGRYKLTYAEAKAV<br>CEFEGGRLATYKQLEAARKIGFHVCAAGWMAKGRVGYPIVKPGPNCGFGKTGIIDYG<br>IRLNRSERWDAYCYNPHAKECGGVFTDPKRIFKSPGFPNEYDDNQVCYWHIRLKYGQ<br>RIHLSFLDFDLEHDPGCLADYVEIYDSYDDVHGFVGRYCGDELPEDIISTGNVMTLK<br>FLSDASVTAGGFQIKYVTVDPASKSSQAKNTSTTGNKKFLPGRFSHL (SEQ ID NO: 52) |
| Human B7-H3 (CD276) | >NM_001024736.2 Homo sapiens CD276 molecule (CD276), transcript variant 1, mRNA<br>ATTCGGGCCGGGCCTCGCTGCGGCGGCGACTGAGCCAGGCTGGGCCGCGTCCCTGAG<br>TCCCAGAGTCGGCGCGGCGCGGCAGGGGCAGCCTTCCACCACGGGGAGCCCAGCTGT<br>CAGCCGCCTCACAGGAAGATGCTGCGTCGGCGGGCAGCCCTGGCATGGGTGTGCAT<br>GTGGGTGCAGCCCTGGGAGCACTGTGGTTCTGCCTCACAGGAGCCCTGGAGGTCCAG<br>GTCCCTGAAGACCCAGTGGTGGCACTGGTGGGCACCAGCCACCCTGTGCTGCTCC<br>TTCTCCCCTGAGCCTGGCTTCAGCCTGGCACAGCTCAACCTCATCTGGCAGCTGACA<br>GATACCCAAACAGCTGGTGCACAGCTTTGCTGAGGGCCAGGACCAGGGCAGCGCCTAT<br>GCCAACCGCACGGCCCTCTTCCCGGACCTGCTGGCACAGGGCAACGCATCCCTGAGG<br>CTGCAGCGCGTGCGTGGCGGACGAGGGCAGCTTCACCTGCTTCGTGAGCATCCGG<br>GATTTCGGCAGCGCTGCCGTCAGCCTGCAGGTGGCCGCTCCTACTCGAAGCCCAGC<br>ATGACCCTGGAGCCCAACAAGGACCTGCGGCCAGGGGACACGGTGACCATCACGTGC<br>TCCAGCTACCAGGGCTACCCTGAGGCTGAGGTGTTCTGGCAGGATGGGCAGGGTGTG<br>CCCCTGACTGGCAACGTGACCACGTCGCAGATGGCCAACGAGCAGGGCTTGTTTGAT<br>GTGCACAGCATCCTGCGGGTGGTGCTGGGTGCAAATGGCACCTACAGCTGCCTGGTG<br>CGCAACCCCGTGCTGCAGCAGGATGCGCACAGCTCTGTCACCATCACACCCCAGAGA<br>AGCCCCACAGGAGCCGTGGAGGTCCAGGTCCCTGAGGACCCGGTGGTGGCCCTAGTG<br>GGCACCGATGCCACCCTGCGCTGCTCCTTCTCCCCCGAGCCTGGCTTCAGCCTGGCA<br>CAGCTCAACCTCATCTGGCAGCTGACAGACACCAAACAGCTGGTGCACAGTTTCACC<br>GAAGGCCGGGACCAGGGCAGCGCCTATGCCAACCGCACGGCCCTCTTCCCGGACCTG<br>CTGGCACAAGGCAATGCATCCCTGAGGCTGCAGCGCGTGCGTGTGGCGGACGAGGGC<br>AGCTTCACCTGCTTCGTGAGCATCCGGGATTTCGGCAGCGCTGCCGTCAGCCTGCAG<br>GTGGCCGCTCCCTACTCGAAGCCCAGCATGACCCTGGAGCCCAACAAGGACCTGCGG<br>CCAGGGGACACGGTGACCATCACGTGCTCCAGCTACCGGGGCTACCCTGAGGCTGAG |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | GTGTTCTGGCAGGATGGGCAGGGTGTGCCCCTGACTGGCAACGTGACCACGTCGCAG<br>ATGGCCAACGAGCAGGGCTTGTTTGATGTGCACAGCGTCCTGCGGGTGGTGCTGGGT<br>GCGAATGGCACCTACAGCTGCCTGGTGCGCAACCCCGTGCTGCAGCAGGATGCGCAC<br>GGCTCTGTCACCATCACAGGGCAGCCTATGACATTCCCCCCAGAGGCCCTGTGGGTG<br>ACCGTGGGGCTGTCTGTCTGTCTCATTGCACTGCTGGTGGCCCTGGCTTTCGTGTGC<br>TGGAGAAAGATCAAACAGAGCTGTGAGGAGGAGAATGCAGGAGCTGAGGACCAGGAT<br>GGGGAGGGAGAAGGCTCCAAGACAGCCCTGCAGCCTCTGAAACACTCTGACAGCAAA<br>GAAGATGATGGACAAGAAATAGCCTGACCATGAGGACCAGGGAGCTGCTACCCCTCC<br>CTACAGCTCCTACCCTCTGGCTGCAATGGGGCTGCACTGTGAGCCCTGCCCCCAACA<br>GATGCATCCTGCTCTGACAGGTGGGCTCCTTCTCCAAAGGATGCGATACACAGACCA<br>CTGTGCAGCCTTATTTCTCCAATGGACATGATTCCCAAGTCATCCTGCTGCCTTTTT<br>TCTTATAGACACAATGAACAGACCACCCACAACCTTAGTTCTCTAAGTCATCCTGCC<br>TGCTGCCTTATTTCACAGTACATACATTTCTTAGGGACACAGTACACTGACCACATC<br>ACCACCCTCTTCTTCCAGTGCTGCGTGGACCATCTGGCTGCCTTTTTTCTCCAAAAG<br>ATGCAATATTCAGACTGACTGACCCCCTGCCTTATTTCACCAAAGACACGATGCATA<br>GTCACCCCGGCCTTGTTTCTCCAATGGCCGTGATACACTAGTGATCATGTTCAGCCC<br>TGCTTCCACCTGCATAGAATCTTTTCTTCTCAGACAGGGACAGTGCGGCCTCAACAT<br>CTCCTGGAGTCTAGAAGCTGTTTCCTTTCCCCTCCTTCCTCCTCTTGCTCTAGCCTT<br>AATACTGGCCTTTTCCCTCCCTGCCCCAAGTGAAGACAGGGCACTCTGCGCCCACCA<br>CATGCACAGCTGTGCATGGAGACCTGCAGGTGCACGTGCTGGAACACGTGTGGTTCC<br>CCCCTGGCCCAGCCTCCTCTGCAGTGCCCCTCTCCCCTGCCCATCCTCCCCACGGAA<br>GCATGTGCTGGTCACACTGGTTCTCCAGGGGTCTGTGATGGGGCCCCTGGGGGTCAG<br>CTTCTGTCCCTCTGCCTTCTCACCTCTTTGTTCCTTTCTTTTCATGTATCCATTCAG<br>TTGATGTTTATTGAGCAACTACAGATGTCAGCACTGTGTTAGGTGCTGGGGGCCCTG<br>CGTGGGAAGATAAAGTTCCTCCCTCAAGGACTCCCCATCCAGCTGGGAGACAGACAA<br>CTAACTACACTGCACCCTGCGGTTTGCAGGGGGCTCCTGCCTGGCTCCCTGCTCCAC<br>ACCTCCTCTGTGGCTCAAGGCTTCCTGGATACCTCACCCCCATCCCACCCATAATTC<br>TTACCCAGAGCATGGGGTTGGGGCGGAAACCTGGAGAGAGGGACATAGCCCCTCGCC<br>ACGGCTAGAGAATCTGGTGGTGTCCAAAATGTCTGTCCAGGTGTGGGCAGGTGGGCA<br>GGCACCAAGGCCCTCTGGACCTTTCATAGCAGCAGAAAAGGCAGAGCCTGGGCAGG<br>GCAGGGCCAGGAATGCTTTGGGGACACCGAGGGGACTGCCCCCCACCCCCACCATGG<br>TGCTATTCTGGGGCTGGGGCAGTCTTTTCCTGGCTTGCCTCTGGCCAGCTCCTGGCC<br>TCTGGTAGAGTGAGACTTCAGACGTTCTGATGCCTTCCGGATGTCATCTCTCCCTGC<br>CCCAGGAATGGAAGATGTGAGGACTTCTAATTTAAATGTGGGACTCGGAGGGATTTT<br>GTAAACTGGGGGTATATTTTGGGGAAAATAAATGTCTTTGTAAAAA (SEQ ID<br>NO: 53)<br><br>>NP_001019907.1 CD276 antigen isoform a precursor [*Homo sapiens*]<br>MLRRRGSPGMGVHVGAALGALWFCLTGALEVQVPEDPVVALVGTDATLCCSFSPEPG<br>FSLAQLNLIWQLTDTKQLVHSFAEGQDQGSAYANRTALFPDLLAQGNASLRLQRVRV<br>ADEGSFTCFVSIRDFGSAAVSLQVAAPYSKPSMTLEPNKDLRPGDTVTITCSSYQGY<br>PEAEVFWQDGQGVPLTGNVTTSQMANEQGLFDVHSILRVVLGANGTYSCLVRNPVLQ<br>QDAHSSVTITPQRSPTGAVEVQVPEDPVVALVGTDATLRCSFSPEPGFSLAQLNLIW<br>QLTDTKQLVHSFTEGRDQGSAYANRTALFPDLLAQGNASLRLQRVRVADEGSFTCFV<br>SIRDFGSAAVSLQVAAPYSKPSMTLEPNKDLRPGDTVTITCSSYRGYPEAEVFWQDG<br>QGVPLTGNVTTSQMANEQGLFDVHSVLRVVLGANGTYSCLVRNPVLQQDAHGSVTIT<br>GQPMTFPPEALWVTVGLSVCLIALLVALAFVCWRKIKQSCEEENAGAEDQDGEGEGS<br>KTALQPLKHSDSKEDDGQEIA (SEQ ID NO: 54) |
| Mouse B7-H3 (CD276) | >NM_133983.4 *Mus musculus* CD276 antigen (Cd276), mRNA<br>CGGCGCGGCGCGCCAAAGTGACCTGGTACAGCCTGGACCCCAAGCTCATCGGCTTTG<br>TCTGGCTGGCCGCCTGGCCTCTTCCCACTTGGATTTGGATGATCCTGAGGCCTTTGG<br>AGGAACTTCGAGACAAAGGCCCCTCTTCCTCTTCCACGGGCAGGAGCAGCCATTCGC<br>CACGGAGAGCCCAGCTGTCAGCTGTCTCACAGGAAGATGCTTCGAGGATGGGGTGGC<br>CCCAGTGTGGGTGTGTGTGTGCGCACAGCACTGGGGGTGCTGTGCCTCTGCCTCACA<br>GGAGCTGTGAAGTCCAGGTCTCTGAAGACCCCGTGGTGGCCTGGTGGACACGGAT<br>GCCACCCTACGCTGCTCCTTTTCCCCAGAGCCTGGCTTCAGTCTGGCACAGCTCAAC<br>CTCATCTGGCAGCTGACAGACACCAAACAGCTGGTCACAGCTTCACGGAGGGCCGG<br>GACCAAGGCAGTGCCTACTCCAACCGCACAGCGCTCTTCCCTGACCTGTTGGTGCAA<br>GGCAATGCGTCCTTGAGGCTGCAGCGCGTCCGAGTAACCGACGAGGGCAGCTACACC<br>TGCTTTGTGAGCATCCAGGACTTTGACAGCGCTGCTGTTAGCCTGCAGGTGGCCGCC<br>CCCTACTCGAAGCCCAGCATGACCCTGGAGCCCAACAAGGACCTACGTCCAGGGAAC<br>ATGGTGACCATCACGTGCTCTAGCTACCAGGGCTATCCGGAGGCCGAGGTGTTCTGG<br>AAGGATGGACAGGGAGTGCCCTTGACTGGCAATGTGACCACATCCCAGATGGCCAAC<br>GAGCGGGGCTTGTTCGATGTTCACAGCGTGCTGAGGGTGGTGCTGGGTGCTAACGGC<br>ACCTACAGCTGCCTGGTACGCAACCCGGTGTTGCAGCAAGATGCTCACGGCTCAGTC<br>ACCATCACAGGGCAGCCCCTGACATTCCCCCCTGAGGCTCTGTGGGTAACCGTGGGG<br>CTCTCTGTCTGTCTTGTGGTACTACTGGTGGCCCTGGCTTTCGTGTGCTGGAGAAAG<br>ATCAAGCAGAGCTGCGAGGAGGAGAATGCAGGTGCCGAGGACCAGGATGGAGATGGA<br>GAAGGATCCAAGACAGCTCTACGCCTCTGAAACCCTCTGAAAACAAAGAAGATGAC<br>GGACAAGAAATTGCTTGATTGGGAGCTGCTGCCCTTCCCAGGTGGGGGCCCACCCT<br>CTGGCAGTGTTGAGCTTCAATGCGAGCCCTTCCCCCAACGAATGGGTTTGTCCCACA<br>GATCTACCCGTTCGTCAAAGGACGTGGTCCATAGACCACCCACAGCCTTACTTTTCC<br>AATGGACTTAATTCCCATCATCCTGCAGCCTCATTTCTCCAGTGACACGATACACGA |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | ACCATCCTGCGGCCTTATTTCCCACGGACACGACACAAAGATGTCCCTCCTCGGTGT<br>TCCTCCAGAGTCGTCTGGTGGCCTTGTGATACGGCGTGAACCTTCTTCCTTCTGCCT<br>TACGTCTAATGGACACACACGCACCACCCCCACACCCTTGCTCCTCCAAAGCCATGC<br>AGACTGTGTAACTGCTATTATTCTCCAAGGGGCATCCTGTGCAGATGAAACCCTGCT<br>TTATTTCCCTGAAGACAGCTGCACAGTGACCTCTTAGTTCTTGCTCCCATGGCCCTG<br>ATGTATCCTAGTTACCAGCCCTCAACCTCAGTTCTGAGGGTGGGATCCCATCGCTCA<br>GCAAGGCTTCATCCTGACCTCCCTGCCCTGATCTGATCTGGCCCTGGCTTTTGTTGT<br>CTCGCTCCCTGACTAAGTGAGATGGGGCACTCTCCCGCCCCCGCCCCCCCCAGGTCA<br>CAGATACCTACCTGCAGCTGTGCGTGCTGGATCACGCACATACTTGCCTTGCATGGT<br>CTCCTGGCTGCCCTGGGCTGTGCCTGTTCTTCCATAGGAAGCAAGTTCTTGTCTCCC<br>TGGTTCTCAGGGCCCCTCAGGGGCTCAGCCTTCAGCCCTGTGCTTCCCCATGTTGGG<br>AATCTTTGTTACCTTTTTCTTCTTTGTAAATTAACATCTGATAACAACCACAGGGTC<br>CAATGGGACTTTCACAGACCTGCCAGCTAGATAAATAATGACAACAGAAGTTTATTA<br>ATATTTTAAGACTTAGGCCTTTTGCTGGGCAGCCTCCCAACTATTCTATCCTGACTA<br>ATCCTGGCACTATGTCCCACCACATGGCCAGGTCTACCTCTCTGCTCCACTCTCCAT<br>CCACCTTCCATGTCTGCCAGCAAATCTCCCGTGATTCAGTTCTTCTCCCAGAGTCCCT<br>ATCTCTGCCCAGAAGTACCATCTTCGACTTCCTGCCCAACTATTGGCCGTCAGCTCT<br>TCATTAAAGCCGATCAGATGTAATTCTAGATTGCCTTAGGCAGGTGAGGAAGAAACA<br>AGTATTTGTAAAATATGAGACCAGCAATGGGCCATAGAAATAACAGCACCAGATCCT<br>GCCAGCATTTAGCCCTCTGTTGGTACAAAATTAACAATTGAATATACAGAGACCTAC<br>TTCCAGAGTGTACCCCAACAACAGGCGTGAGCATGGTGCTGGGTACTAGGGTCCTGC<br>TGGAAAATCAGAGACCTTACCTACAGCTGGGACATGACCTTGCTTCCGACTTACCCA<br>CCACTTCTGGATACCTCACCCTCAGCCCACACTATCCCTGGCCTAGGGCCCAGGGTA<br>GAGCCAGAAACATGGAGAAAGCATGGCCCCTTGCCGTACCTGGAGAACTGGGTATTT<br>TCCAGAGTCTTTATAGATGTGGACTGGAAGGCAGGTGGCCACAGCCGTGCAGACCTG<br>GGTCAGGTCAGAAACCTATGCCATGCTGGGACCTACTCAACAGCAGAAGCATGAAGA<br>GGGCCTGAGGACAAGAAAGGCCTTCTTACCATGGTGCTATTCTGGAGCTGGGATATA<br>TACCTGGCTTGTCTCTGACTGCCCTGGCTTCTGGCAGAACTTCTGATGTCCTCCTGA<br>AGGCCTCTCTCCCACCCCAGTACCTGAGAACCTGAGGATAATTTAAACATGGGACTC<br>TGGCCAGCACCTGGGAGAGACAGGTAGATCTCTGATTTTTGACTCAGCCTGGTCTAT<br>CGAGTGAGTTCCAGGACATCTGGGGCTACACAGAGAAACCATCTTAAAGACTAAAAA<br>TAATAAACATGAGACTGTAAACTGGGTGTATTTTGGGAGAAATAAATGTCTTTTTCT<br>TTCAA (SEQ ID NO: 55)<br><br>>NP_598744.1 0D276 antigen precursor [Mus musculus]<br>MLRGWWGGPSVGVCVRTALGVLCLCLTGAVEVQVSEDPVVALVDTDATLRCSFSPEPG<br>FSLAQLNLIWQLTDTKQLVHSFTEGRDQGSAYSNRTALFPDLLVQGNASLRLQRVRV<br>TDEGSYTCFVSIQDFDSAAVSLQVAAPYSKPSMTLEPNKDLRPGNMVTITCSSYQGY<br>PEAEVFWKDGQGVPLTGNVTTSQMANERGLFDVHSVLRVVLGANGTYSCLVRNPVLQ<br>QDAHGSVTITGQPLTFPPEALWVTVGLSVCLVVLLVALAFVCWRKIKQSCEEENAGA<br>EDQDGDGEGSKTALRPLKPSENKEDDGQEIA (SEQ ID NO: 56) |
| Human B7-H4 (VTCN1) | >NM_024626.4 Homo sapiens V-set domain containing T cell activation inhibitor 1 (VTCN1), transcript variant 1, mRNA<br>GTGAGTCACCAAGGAAGGCAGCGGCAGCTCCACTCAGCCAGTACCCAGATACGCTGG<br>GAACCTTCCCCAGCCATGGCTTCCCTGGGGCAGATCCTCTTCTGGAGCATAATTAGC<br>ATCATCATTATTCTGGCTGGAGCAATTGCACTCATCATTGGCTTTGGTATTTCAGGG<br>AGACACTCCATCACAGTCACTACTGTCGCCTCAGCTGGGAACATTGGGGAGGATGGA<br>ATCCTGAGCTGCACTTTTGAACCTGACATCAAACTTTCTGATATCGTGATACAATGG<br>CTGAAGGAAGGTGTTTTAGGCTTGGTCCATGAGTTCAAAGAAGGCAAAGATGAGCTG<br>TCGGAGCAGGATGAAATGTTCAGAGGCCGGACAGCAGTGTTTGCTGATCAAGTGATA<br>GTTGGCAATGCCTCTTTGCGGCTGAAAAACGTGCAACTCACAGATGCTGGCACCTAC<br>AAATGTTATATCATCACTTCTAAAGGCAAGGGGAATGCTAACCTTGAGTATAAAACT<br>GGAGCCTTCAGCATGCCGGAAGTGAATGTGGACTATAATGCCAGCTCAGAGACCTTG<br>CGGTGTGAGGCTCCCCGATGGTTCCCCCAGCCCACAGTGGTCTGGGCATCCCAAGTT<br>GACCAGGGAGCCAACTTCTCGGAAGTCTCCAATACCAGCTTTGAGCTGAACTCTGAG<br>AATGTGACCATGAAGGTTGTGTCTGTGCTCTACAATGTTACGATCAACAACACATAC<br>TCCTGTATGATTGAAAATGACATTGCCAAAGCAACAGGGGATATCAAAGTGACAGAA<br>TCGGAGATCAAAAGGCGGAGTCACCTACAGCTGCTAAACTCAAAGGCTTCTCTGTGT<br>GTCTCTTCTTTCTTTGCCATCAGCTGGGCACTTCTGCCTCTCAGCCCTTACCTGATG<br>CTAAAATAATGTGCCTCGGCCACAAAAAAGCATGCAAAGTCATTGTTACAACAGGGA<br>TCTACAGAACTATTTCACCACCAGATATGACCTAGTTTTATATTTCTGGGAGGAAAT<br>GAATTCATATCTAGAAGTCTGGAGTGAGCAAACAAGAGCAAGAAACAAAAAGAAGCC<br>AAAAGCAGAAGGCTCCAATATGAACAAGATAAATCTATCTTCAAAGACATATTAGAA<br>GTTGGGAAAATAATTCATGTGAACTAGACAAGTGTGTTAAGAGTGATAAGTAAAATG<br>CACGTGGAGACAAGTGCATCCCCAGATCTCAGGGACCTCCCCCTGCCTGTCACCTGG<br>GGAGTGAGAGGACAGGATAGTGCATGTTCTTTGTCTCTGAATTTTTAGTTATATGTG<br>CTGTAATGTTGCTCTGAGGAAGCCCCTGGAAAGTCTATCCCAACATATCCACATCTT<br>ATATTCCACAAATTAAGCTGTAGTATGTACCCTAAGACGCTCTAATTGACTGCCAC<br>TTCGCAACTCAGGGGCGGCTGCATTTTAGTAATGGGTCAAATGATTCACTTTTTATG<br>ATGCTTCCAAAGGTGCCTTGGCTTCTCTTCCCAACTGACAAATGCCAAAGTTGAGAA<br>AAATGATCATAATTTTAGCATAAACAGAGCAGTCGGCGACACCGATTTTATAAATAA<br>ACTGAGCACCTTCTTTTTAAACAAACAATGCGGGTTTATTTCTCAGATGATGTTCA<br>TCCGTGAATGGTCCAGGGAAGGACCTTTCACCTTGTCTATATGGCATTATGTCATCA |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | CAAGCTCTGAGGCTTCTCCTTTCCATCCTGCGTGGACAGCTAAGACCTCAGTTTTCA<br>ATAGCATCTAGAGCAGTGGGACTCAGCTGGGGTGATTTCGCCCCCCATCTCCGGGGG<br>AATGTCTGAAGACAATTTTGGTTACCTCAATGAGGGAGTGGAGGAGGATACAGTGCT<br>ACTACCAACTAGTGGATAGAGGCCAGGGATGCTGCTCAACCTCCTACCATGTACAGG<br>ACGTCTCCCCATTACAACTACCCAATCCGAAGTGTCAACTGTGTCAGGGCTAAGAAA<br>CCCTGGTTTTGAGTAGAAAAGGGCCTGGAAAGAGGGGAGCCAACAAATCTGTCTGCT<br>TCCTCACATTAGTCATTGGCAAATAAGCATTCTGTCTCTTTGGCTGCTGCCTCAGCA<br>CAGAGAGCCAGAACTCTATCGGGCACCAGGATAACATCTCTCAGTGAACAGAGTTGA<br>CAAGGCCTATGGGAAATGCCTGATGGGATTATCTTCAGCTTGTTGAGCTTCTAAGTT<br>TCTTTCCCTTCATTCTACCCTGCAAGCCAAGTTCTGTAAGAGAAATGCCTGAGTTCT<br>AGCTCAGGTTTTCTTACTCTGAATTTAGATCTCCAGACCCTGCCTGGCCACAATTCA<br>AATTAAGGCAACAAACATATACCTTCCATGAAGCACACACAGACTTTTGAAAGCAAG<br>GACAATGACTGCTTGAATTGAGGCCTTGAGGAATGAAGCTTTGAAGGAAAAGAATAC<br>TTTGTTTCCAGCCCCCTTCCCACACTCTTCATGTGTTAACCACTGCCTTCCTGGACC<br>TTGGAGCCACGGTGACTGTATTACATGTTGTTATAGAAAACTGATTTTAGAGTTCTG<br>ATCGTTCAAGAGAATGATTAAATATACATTTCCTACACCA (SEQ ID NO: 57)<br><br>>NP_078902.2 V-set domain-containing T-cell activation<br>inhibitor 1 isoform 1 precursor [Homo sapiens]<br>MASLGQILFWSIISIIIILAGAIALIIGFGISGRHSITVTTVASAGNIGEDGILSCT<br>FEPDIKLSDIVIQWLKEGVLGLVHEFKEGKDELSEQDEMFRGRTAVFADQVIVGNAS<br>LRLKNVQLTDAGTYKCYIITSKGKGNANLEYKTGAFSMPEVNVDYNASSETLRCEAP<br>RWFPQPTVVWASQVDQGANFSEVSNTSFELNSENVTMKVVSVLYNVTINNTYSCMIE<br>NDIAKATGDIKVTESEIKRRSHLQLLNSKASLCVSSFFAISWALLPLSPYLMLK<br>(SEQ ID NO: 58) |
| Mouse B7-H4<br>(VTCN1) | >NM_178594.3 Mus musculus V-set domain containing T cell<br>activation inhibitor 1 (Vtcn1), mRNA<br>GTGAGTCACAACACCCAGGAGGGCAGCAGCAGGCAGGCAGCTCCACTCACCAAAATC<br>TGGCCCCACACACAGCAGGACTGTGGGAAGGAACTCCCTCTCCATGGCTTCCTTGGG<br>GCAGATCATCTTTTGGAGTATTATTAACATCATCATCATCCTGGCTGGGGCCATCGC<br>ACTCATCATTGGCTTTGGCATTTCAGGCAAGCACTTCATCACGGTCACGACCTTCAC<br>CTCAGCTGGAAACATTGGAGAGGACGGGACCCTGAGCTGCACTTTTGAACCTGACAT<br>CAAACTCAACGGCATCGTCATCCAGTGGCTGAAAGAAGGCATCAAAGGTTTGGTCCA<br>CGAGTTCAAAGAAGGCAAAGACGACCTCTCACAGCAGCATGAGATGTTCAGAGGCCG<br>CACAGCAGTGTTTGCTGATCAGGTGGTAGTTGGCAATGCTTCCCTGAGACTGAAAAA<br>CGTGCAGCTCACGGATGCTGGCACCTACACATGTTACATCCGCACCTCAAAAGGCAA<br>AGGGAATGCAAACCTTGAGTATAAGACCGGAGCCTTCAGTATGCCAGAGATAAATGT<br>GGACTATAATGCCAGTTCAGAGAGTTTACGCTGCGAGGCTCCTCGGTGGTTCCCCCA<br>GCCCACAGTGGCCTGGGCATCTCAAGTCGACCAAGGAGCCAATTTCTCAGAAGTCTC<br>CAACACCAGCTTTGAGTTGAACTCTGAGAATGTGACCATGAAGGTCGTATCTGTGCT<br>CTACAATGTCACAATCAACAACACATACTCCTGTATGATTGAAAACGACATTGCCAA<br>AGCCACCGGGGACATCAAAGTGACAGATTCAGAGGTCAAAAGGCGAAGTCAGCTGCA<br>GTTGCTGAACTCTGGGCCTTCCCCGTGTGTTTTTTCTTCTGCCTTTGTGGCTGGCTG<br>GCACTCCTATCTCTCTCCTGTTGCCTGATGCTAAGATGAGGGGCCCTGGCTACACA<br>AAAGCATGCAACGTTGCTGGTCCAACAGAATCCCGGAGAACTACAGAAATATTTTCC<br>TCAAGACATGACCTAGTTTTATATTTCTAGAAGAAGATGAAATCATGTCTAGAAGTC<br>TGGAGAGAGCAGACAGGAACAAGATGTGGAAGGAAAACAAAAGTAACCCACAGACAC<br>CCCCGATCGGAACAAGATGACCTAGAAAATAATTCAACCAAACTAGAGTATACTAA<br>GTGTGCTGTTACAATGTGTGTAGGGTAGGTGTCCTCCCACATCTCAGGGGCCTCCCC<br>TGGTCCACCAGCTCCTGAGTTAGGATGGGCTGTTATGATGTCACTCTGAAGGTTCCT<br>GGATGGTTCCTACTGCCATATACTCATTTTATATTCAGCACATTAAACCATAGTGAA<br>TGCTATGAAAAGCTGCTAATCAGCTGCCACTCCGAGATTCGGAGGTGGCAACGTCTG<br>AGTGACAGGTCCAGTGATTCGCTTCTCCTTAGGATGCTTTTACAAGCTCTTTGGCGT<br>CTCCTCCCACCTGGCAAATGCCAAATGCATAGGGGAGGGTGATCATCATTCTAGGGC<br>AAACAAAATAGTTGAGGGATGCTGATTTCCCAAATCATCCGAATCACTTCTCCCTTG<br>AGCAAACAAGCGCCCTGTTATTTCTCAAATGCTGCTTTGTGAATCAGTCCAGGGCAA<br>GGCGCTCTCCTCATCCCGCTATGTGGCCTTAAGTCATCGTAAGGTTTGAAGTTTCTA<br>CTTTCGATCCTGCATGGAGAGCTATAATCTCAGCTCCCCCGCCCCCCCCACACACAC<br>CTCTGCACACACACCCCCCCCCAACACTGGGAGTAAACCAGGATGATGTCCGTCTTC<br>TCATTCCCCATGTGACCGTTGGCAGTGTAGAGAGACTGATTGTCACAGCTAAAGGAA<br>GAGGGACAACAGGGTCACTGGTGTCTACAGAGATTATATTCTACGTGTCTCACTGAA<br>TTTACACAACTCCAAGTGCCAACCACATCAAGGTCAGGAAATCCTGAACTGGAATAA<br>GAAAGACCCAGAAGATGAATGTGAACAGATCCATTTGCTTCCCGACAGTGGGCACAG<br>ACTTCAGTCTCTGGCTACTGTTCCAAGACCCAGGGCTCTGCAATTGTGTGACATCCT<br>TCAGTGAACCCACATGGGAAATTCTCCATGGAATTATCTTCAGCCCCACTGTACTTCT<br>GAATCCCTCTTCCTTCCTTCTGTGCCACACAGCAAGTCTGGCTTAAATGCTGCCTGA<br>TCTCCATTTCAAGTTTTCTGCCTCTGGATTTTTAGATCTCAAGACCATGGACGAAAC<br>ATCAGTTACAGCAACAAAAGTGAATTTTCCGTGCAGAGACTTCTAGGGGTTCTGTTT<br>GTTTTCAGGGTGCTAGAGATCACACTCAGATGCTCATATATGTTAGGTAAATGTTCT<br>CCCACTGAGTTACAGCCCAGCTCACACAGAGACTTCTAAAAGAAAATACGGCCATGC<br>TCTTTGAAATGGAGCATTGAGGGATGAAGTTTGGATGGCGAAGAAAACTTCTCACCA<br>GCTCTCTCCCCACATTCGTGCCAAGCACTGCCTCCCTAGACTTCGGGTCACCATATC<br>TGTACTACGTTTTGATACAGAAGGCTCGAGACCATTCAAGAGAATTATTTAGTACAC<br>(SEQ ID NO: 59) |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | >NP_848709.2 V-set domain containing T-cell activation<br>inhibitor 1 precursor [Mus musculus]<br>MASLGQIIFWSIINIIILAGAIALIIGFGISGKHFITVTTFTSAGNIGEDGTLSCT<br>FEPDIKLNGIVIQWLKEGIKGLVHEFKEGKDDLSQQHEMFRGRTAVFADQVVVGNAS<br>LRLKNVQLTDAGTYTCYIRTSKGKGNANLEYKTGAFSMPEINVDYNASSESLRCEAP<br>RWFPQPTVAWASQVDQGANFSEVSNTSFELNSENVTMKVVSVLYNVTINNTYSCMIE<br>NDIAKATGDIKVTDSEVKRRSQLQLLNSGPSPCVFSSAFVAGWALLSLSCCLMLR<br>(SEQ ID NO: 60) |
| Human B7-H5<br>(VISTA) | >NM_022153.2 Homo sapiens V-set immunoregulatory receptor<br>(VSIR), mRNA<br>AGTCGCGGGAGGCTTCCCCGCGCCGGCCGCGTCCCGCCCGCTCCCCGGCACCAGAAG<br>TTCCTCTGCGCGTCCGACGGCGACATGGGCGTCCCCACGGCCCTGGAGGCCGGCAGC<br>TGGCGCTGGGGATCCCTGCTCTTCGCTCTCTTCCTGGCTGCGTCCCTAGGTCCGGTG<br>GCAGCCTTCAAGGTCGCCACGCCGTATTCCCTGTATGTCTGTCCCGAGGGGCAGAAC<br>GTCACCCTCACCTGCAGGCTCTTGGGCCCTGTGGACAAAGGGCACGATGTGACCTTC<br>TACAAGACGTGGTACCGCAGCTCGAGGGGCGAGGTGCAGACCTGCTCAGAGCGCCGG<br>CCCATCCGCAACCTCACGTTCCAGGACCTTCACCTGCACCATGGAGGCCACCAGGCT<br>GCCAACACCAGCCACGACCTGGCTCAGCGCCACGGGCTGGAGTCGGCCTCCGACCAC<br>CATGGCAACTTCTCCATCACCATGCGCAACCTGACCCTGCTGGATAGCGGCCTCTAC<br>TGCTGCCTGGTGGTGGAGATCAGGCACCACCACTCGGAGCACAGGGTCCATGGTGCC<br>ATGGAGCTGCAGGTGCAGACAGGCAAAGATGCACCATCCAACTGTGTGGTGTACCCA<br>TCCTCCTCCCAGGATAGTGAAAACATCACGGCTGCAGCCCTGGCTACGGGTGCCTGC<br>ATCGTAGGAATCCTCTGCCTCCCCCTCATCCTGCTCCTGGTCTACAAGCAAAGGCAG<br>GCAGCCTCCAACCGCCGTGCCCAGGAGCTGGTGCGGATGGACAGCAACATTCAAGGG<br>ATTGAAAACCCCGGCTTTGAAGCCTCACCACCTGCCCAGGGGATACCCGAGGCCAAA<br>GTCAGGCACCCCCTGTCCTATGTGGCCCAGCGGCAGCCTTCTGAGTCTGGGCGGCAT<br>CTGCTTTCGGAGCCCAGCACCCCCTGTCTCCTCCAGGCCCCGGAGACGTCTTCTTC<br>CCATCCCTGGACCCTGTCCCTGACTCTCCAAACTTTGAGGTCATCTAGCCCAGCTGG<br>GGGACAGTGGGCTGTTGTGGCTGGGTCTGGGCAGGTGCATTTGAGCCAGGGCTGGC<br>TCTGTGAGTGGCCTCCTTGGCCTCGGCCCTGGTTCCCTCCCTCCTGCTCTGGGCTCA<br>GATACTGTGACATCCCAGAAGCCCAGCCCCTCAACCCCTCTGGATGCTACATGGGGA<br>TGCTGGACGGCTCAGCCCCTGTTCCAAGGATTTTGGGGTGCTGAGATTCTCCCCTAG<br>AGACCTGAAATTCACCAGCTACAGATGCCAAATGACTTACATCTTAAGAAGTCTCAG<br>AACGTCCAGCCCTTCAGCAGCTCTCGTTCTGAGACATGAGCCTTGGGATGTGGCAGC<br>ATCAGTGGGACAAGATGGACACTGGGCCACCCTCCCAGGCACCAGACACAGGGCACG<br>GTGGAGAGACTTCTCCCCCGTGGCCGCCTTGGCTCCCCGTTTTGCCCGAGGCTGCT<br>CTTCTGTCAGACTTCCTCTTTGTACCACAGTGGCTCTGGGGCCAGGCCTGCCTGCCC<br>ACTGGCCATCGCCACCTTCCCCAGCTGCCTCCTACCAGCAGTTTCTCTGAAGATCTG<br>TCAACAGGTTAAGTCAATCTGGGGCTTCCACTGCCTGCATTCCAGTCCCCAGAGCTT<br>GGTGGTCCCGAAACGGGAAGTACATATTGGGGCATGGTGGCCTCCGTGAGCAAATGG<br>TGTCTTGGGCAATCTGAGGCCAGGACAGATGTTGCCCCACCCACTGGAGATGGTGCT<br>GAGGGAGGTGGGTGGGGCCTTCTGGGAAGGTGAGTGGAGAGGGGCACCTGCCCCCCG<br>CCCTCCCCATCCCCTACTCCCACTGCTCAGCGCGGGCCATTGCAAGGGTGCCACACA<br>ATGTCTTGTCCACCCTGGGACACTTCTGAGTATGAAGCGGGATGCTATTAAAAACTA<br>CATGGGGAAACAGGTGCAAACCCTGGAGATGGATTGTAAGAGCCAGTTTAAATCTGC<br>ACTCTGCTGCTCCTCCCCCACCCCCACCTTCCACTCCATACAATCTGGGCCTGGTGG<br>AGTCTTCGCTTCAGAGCCATTCGGCCAGGTGCGGGTGATGTTCCCATCTCCTGCTTG<br>TGGGCATGCCCTGGCTTTGTTTTTATACACATAGGCAAGGTGAGTCCTCTGTGGAAT<br>TGTGATTGAAGGATTTTAAAGCAGGGGAGGAGAGTAGGGGGCATCTCTGTACACTCT<br>GGGGGTAAAACAGGGAAGGCAGTGCCTGAGCATGGGGACAGGTGAGGTGGGGCTGGG<br>CAGACCCCCTGTAGCGTTTAGCAGGATGGGGGCCCCAGGTACTGTGGAGAGCATAGT<br>CCAGCCTGGGCATTTGTCTCCTAGCAGCCTACACTGGCTCTGCTGAGCTGGGCCTGG<br>GTGCTGAAAGCCAGGATTTGGGGCTAGGCGGGAAGATGTTCGCCCAATTGCTTGGGG<br>GGTTGGGGGATGGAAAAGGGGAGCACCTCTAGGCTGCCTGGCAGCAGTGAGCCCTG<br>GGCCTGTGGCTACAGCCAGGGAACCCCACCTGGACACATGGCCCTGCTTCTAAGCCC<br>CCCAGTTAGGCCCAAAGGAATGGTCCACTGAGGGCCTCCTGCTCTGCCTGGGCTGGG<br>CCAGGGGCTTTGAGGAGAGGGTAAACATAGGCCCGGAGATGGGGCTGACACCTCGAG<br>TGGCCAGAATATGCCCAAACCCCGGCTTCTCCCTTGTCCCTAGGCAGAGGGGGGTCC<br>CTTCTTTTGTTCCCTCTGGTCACCACAATGCTTGATGCCAGCTGCCATAGGAAGAGG<br>GTGCTGGCTGGCCATGGTGGCACACACCTGTCCTCCCAGCACTTTGCAGGGCTGAGG<br>TGGAAGGACCGCTTAAGCCCAGGTGTTCAAGGCTGCTGTGAGCTGTGTTCGAGCCAC<br>TACACTCCAGCCTGGGGACGGAGCAAAACTTTGCCTCAAAACAAATTTTAAAAGAA<br>AGAAAGAAGGAAAGAGGGTATGTTTTTCACAATTCATGGGGGCCTGCATGGCAGGAG<br>TGGGGACAGGACACCTGCTGTTCCTGGAGTCGAAGGACAAGCCCACAGCCCAGATTC<br>CGGTTCTCCCAACTCAGGAAGAGCATGCCCTGCCCTCTGGGGAGGCTGGCCTGGCCC<br>CAGCCCTCAGCTGCTGACCTTGAGGCAGAGACAACTTCTAAGAATTTGGCTGCCAGA<br>CCCCAGGCCTGGCTGCTGCTGTGTGGAGAGGGAGGCGGCCCGCAGCAGAACAGCCAC<br>CGCACTTCCTCCTCAGCTTCCTCTGGTGCGGCCCTGCCCTCTCTTCTCTGGACCCTT<br>TTACAACTGAACGCATCTGGGCTTCGTGGTTTCCTGTTTTCAGCGAAATTTACTCTG<br>AGCTCCCAGTTCCATCTTCATCCATGGCCACAGGCCCTGCCTACAACGCACTAGGGA<br>CGTCCCTCCCTGCTGCTGCTGGGGAGGGGCAGGCTGCTGGAGCCGCCCTCTGAGTTG<br>CCCGGGATGGTAGTGCCTCTGATGCCAGCCCTGGTGGCTGTGGGCTGGGGTGCATGG<br>GAGAGCTGGGTGCGAGAACATGGCGCCTCCAGGGGGCGGGAGGAGCACTAGGGGCTG |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | GGGCAGGAGGCTCCTGGAGCGCTGGATTCGTGGCACAGTCTGAGGCCCTGAGAGGGA<br>AATCCATGCTTTTAAGAACTAATTCATTGTTAGGAGATCAATCAGGAATTAGGGGCC<br>ATCTTACCTATCTCCTGACATTCACAGTTTAATAGAGACTTCCTGCCTTTATTCCCT<br>CCCAGGGAGAGGCTGAAGGAATGGAATTGAAAGCACCATTTGGAGGGTTTTGCTGAC<br>ACAGCGGGGACTGCTCAGCACTCCCTAAAAACACACCATGGAGGCCACTGGTGACTG<br>CTGGTGGGCAGGCTGGCCCTGCCTGGGGGAGTCCGTGGCGATGGGCGCTGGGGTGGA<br>GGTGCAGGAGCCCCAGGACCTGCTTTTCAAAAGACTTCTGCCTGACCAGAGCTCCCA<br>CTACATGCAGTGGCCCAGGGCAGAGGGGCTGATACATGGCCTTTTTCAGGGGGTGCT<br>CCTCGCGGGGTGGACTTGGGAGTGTGCAGTGGGACAGGGGGCTGCAGGGGTCCTGCC<br>ACCACCGAGCACCAACTTGGCCCCTGGGGTCCTGCCTCATGAATGAGGCCTTCCCCA<br>GGGCTGGCCTGACTGTGCTGGGGGCTGGGTTAACGTTTTCTCAGGGAACCACAATGC<br>ACGAAAGAGGAACTGGGGTTGCTAACCAGGATGCTGGGAACAAAGGCCTCTTGAAGC<br>CCAGCCACAGCCCAGCTGAGCATGAGGCCCAGCCCATAGACGGCACAGGCCACCTGG<br>CCCATTCCCTGGGCATTCCCTGCTTTGCATTGCTGCTTCTCTTCACCCCATGGAGGC<br>TATGTCACCCTAACTATCCTGGAATGTGTTGAGAGGGATTCTGAATGATCAATATAG<br>CTTGGTGAGACAGTGCCGAGATAGATAGCCATGTCTGCCTTGGGCACGGGAGAGGGA<br>AGTGGCAGCATGCATGCTGTTTCTTGGCCTTTTCTGTTAGAATACTTGGTGCTTTCC<br>AACACACTTTCACATGTGTTGTAACTTGTTTGATCCACCCCCTTCCCTGAAAATCCT<br>GGGAGGTTTTATTGCTGCCATTTAACACAGAGGGCAATAGAGGTTCTGAAAGGTCTG<br>TGTCTTGTCAAAACAAGTAAACGGTGGAACTACGACTAAA (SEQ ID NO: 61)<br><br>>NP_071436.1 V-type immunoglobulin domain-containing<br>suppressor of T-cell activation precursor [Homo sapiens]<br>MGVPTALEAGSWRWGSLLFALFLAASLGPVAAFKVATPYSLYVCPEGQNVTLTCRLL<br>GPVDKGHDVTFYKTWYRSSRGEVQTCSERRPIRNLTFQDLHLHHGGHQAANTSHDLA<br>QRHGLESASDHHGNFSITMRNLTLLDSGLYCCLVVEIRHHHSEHRVHGAMELQVQTG<br>KDAPSNCVVYPSSSQDSENITAAALATGACIVGILCLPLILLLVYKQRQAASNRRAQ<br>ELVRMDSNIQGIENPGFEASPPAQGIPEAKVRHPLSYVAQRQPSESGRHLLSEPSTP<br>LSPPGPGDVFFPSLDPVPDSPNFEVI (SEQ ID NO: 62) |
| Mouse B7-H5 (VISTA) | >NM_028732.4 Mus musculus V-set immunoregulatory receptor (Vsir), transcript variant 1, mRNA<br>GGGGCGCTGCTGGGCGGGAGCTTGCTCGGCCGCCTGCCTCGCCTTGGGCTCAGCA<br>TTCACTCTAGCGAGCGAGCGGCGTGTACAGCCGGCTCCCTGGGCTCCTGGAGTCCCG<br>CTTGCTCCAAGCGCACTCCAGCAGTCTCTTTCTGCTCTTGCCCGGCTCGACGGCGAC<br>ATGGGTGTCCCCGCGGTCCCAGAGGCCAGCAGCCCGCGCTGGGGAACCCTGCTCCTT<br>GCTATTTTCCTGGCTGCATCCAGAGGTCTGGTAGCAGCCTTCAAGGTCACCACTCCA<br>TATTCTCTCTATGTGTGTCCCGAGGGACAGAATGCCACCCTCACCTGCAGGATTCTG<br>GGCCCCGTGTCCAAAGGGCACGATGTGACCATCTACAAGACGTGGTACCTCAGCTCA<br>CGAGGCGAGGTCCAGATGTGCAAAGAACACCGGCCCATACGCAACTTCACATTGCAG<br>CACCTTCAGCACCACGGAAGCCACCTGAAAGCCAACGCCAGCCATGACCAGCCCCAG<br>AAGCATGGGCTAGAGCTAGCTTCTGACCACCACGGTAACTTCTCTATCACCCTGCGC<br>AATGTGACCCCAAGGGACAGCGGCCTCTACTGCTGTCTAGTGATAGAATTAAAAAAC<br>CACCACCCAGAACAACGGTTCTACGGGTCCATGGAGCTACAGGTACAGGCAGGCAAA<br>GGCTCGGGGTCCACATGCATGGCGTCTAATGAGCAGGACAGTGACAGCATCACGGCT<br>GCGGCCCTGGCCACCGGCGCCTGCATCGTGGGAATCCTCTGCCTCCCCCTTATCCTG<br>CTGCTGGTCTATAAGCAGAGACAGGTGGCCTCTCACCGCCGTGCCCAGGAGTTGGTG<br>AGGATGGACAGCAGCAACACCCAAGGAATCGAAAACCCAGGCTTCGAGACCACTCCA<br>CCCTTCCAGGGGATGCCTGAGGCCAAGACCAGGCCGCCACTGTTCTATGTGGCCCAG<br>CGGCAACCTTCGGAGTCAGGACGGTACCTGCTCTCTGACCCCAGCACACCTCTGTCG<br>CCTCCAGGCCCTGGGGACGTCTTTTTCCCATCCCTAGATCCAGTCCCTGACTCCCCT<br>AACTCTGAAGCCATCTAAACCAGCTGGGGAACCATGAACCATGGTACCTGGGTCAGG<br>GATATGTGCACTTGATCTATGGCTGGCCCTTGGACAGTCTTTTAGGCACTGACTCCA<br>GCTTCCTTGCTCCTGCTCTGAGCCTAGACTCTGCTTTTACAAGATGCACAGACCCTC<br>CCCTATCTCTTTCAGACGCTACTTGGGGGGCAGGGAGAAGATGTTGGATTGCTCATT<br>GCTGTTCTCAAGATCTTGGGATGCTGAGTTCTCCCTAGAGACTTGACTTCGACAGCC<br>ACAGATGTCAGATGACCTGCATCCTATGAACGTCCGGCTTGGCAAGAGCCTTTCTTC<br>ATGGAAACCAGTAGCCCGGAGGGGATGAGGTAGGCACCTTGCCACCCTCCCGGGAGA<br>GAGACACAAGATGTGAGAGACTCCTGCTCACTGTGGGGGTGTGGCTGGCCTGCTTGT<br>TTGCCTGAGGATGCTCCTCTGTTGGACTGACTCTATCCCCCTGGATTCTGGAGCTTG<br>GCTGGCCTATGTCCCACCAGAGGAGCATCTCAGCAGCCTTCCACCAGCAACCTGAGG<br>GCCTGCCAGCTTCGTGGCTCTGGGCTCTCATTACCTGTATGCCGTCCACAGAGCTC<br>AGTGGCCAGAGGCTTTGAAACAGGAAGTACATGTCAGGTTCAGGAACACTGTGAGC<br>TCATTAGTGTCTTGAGCAATGTGAGGCCTGGACCAGTGGACACGGAGGGAGGGTGGC<br>GAGAGGATGATGGGGATGATGAGGGGAACACGCTCCCTTCCTGTCCTTGTCATCCAC<br>CACTACCACTATTCAGTGTGGAGCAGTGGCAAAGGTGACCGACCTCCACAATGTCCT<br>AGTGATGCTGGACCATTTCTAAGTGTGAAAGAGATGCTATTAAAAACAGTATGTGGC<br>AATGGCTGCCAACAGCTGAGTGGACTGGAGGCACTGGCTTTAAGGCCCTGGAGGTGC<br>AGGGCCCGGTATGGGGATAGGGATGGGAGTTTCAGTGAGGGCCTAGGGATCACTCCG<br>CTTCTGACCACTCTTCTTCTGAGCCTCACCTCAGGGTGACCTTCAGGCACACAGAAG<br>AGCTTGCCCCTGGTCCGATACTACTCTTGGCTCTCATCTCCAGGGTTTGGCATGACC<br>TGGGCACACAGGGGAGTCTTCAGAAAGGATTTTAAAGCATGAAAAGAAAGGGTAGT<br>TCTTGTGAGGTAGGGATGGGCAGCTGATGTTTGAGAGTGAGGAGGGATACGGCTGGG<br>CAGATCACTCTCCAGTCTCTAGAGGGAAAGTAGCTCTAAGTCTGGGAGAGCAGCAGC<br>CCAGTGGTACCATATGTCTTCTTGCAGCTTCCACTGGCTGGGCTGAACTGGGCATGG |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | GTAGGAAAGCTCCTGTTCTGGGCCTGCAGCCAGGGAGAACCCCATTCATTCCCTGAG<br>GACAGATGGGTGGGGAGAGAAGAGAGAGTTTCAGGCCGGGAAGCAGCAATAAGCTAT<br>CTGCTGGGGACCCAGACAAGTTGTCTGATGAGGTCCAAGATGTGGGATGCCAGTTAT<br>ACCTGGGGCTTGGGGATCCTTAGAGGCTTTGTATCATCATCATAGGAGTGTCGGGGT<br>GGCCAGGGCATCAAAGCCATGACCCCTGTTTTATCCTCAGGGTCCACTCTTCTGCAC<br>CATCCATTGCTCTAGATCTATGCAGTTACTATAGACAGAATGTGTTGTTCTGTTTGG<br>CTTTGGGGATAATGGCCTGGCGAACTGCCAGCTGTTCAGTGGCAGGGCTGTGAGGCC<br>AGTCAAAGACTAGAACCCACAGACCAGCTGAACGATGAGTATAGCCTGTCCCCTGGG<br>GGAGCCTGACCTGTCTCCAGCCCTAAGCTTCAGACCTCACCACTCAGATGACTTCTA<br>AGAATTTGCCTGTGGGGACCCCTGCATGGCTGCAGCTCCGTGGAAAGGAGAGGAGGC<br>CCCCAGCAGAAGAACCACTCGCTTCCTGCCCAGCTTCCTCCTGTAGGGCTCTAAGTC<br>TCTTCTTCTTGGGACCCTGCAAGCAAAGGCATGTCAGCTTGGTGGTTTCCTGTTTTG<br>GGTGAAGTTTTGTGTGGTCCGGGTTCTGTCTACATCCATGAACTTGGGTGCTACCAC<br>CTTGCTGCTGCTGTAGAGACAGCTGCAGGATCTTAGGGTGGAAAATGGAGGTGCCCT<br>GAGGTGCTAGCCCTTGGGGCAAAAGATGGGGTGGCAATGAGACACAGTGGGGAACTG<br>AGTTCCCCAAGAGGAGGGAGGAGCCCTGTAGCCTCAAGGGCCATATTGGGTTCCTGG<br>TACCAGCAAAAGCCTAGAGAGCGAAGTCTGTATTTTGAGGAGGTAATTGATCCTTAC<br>GGAATCCATCAGAAATTTGGAGCGGGTGCTTTATCTATCTCTGGAGGGTCTCTACCT<br>ATCTCCGATGAAGCTCTCCCTGGGCCTGGGATGGGAGAAACCAGGAGGAAAGGTGTC<br>TGATAAAGCAGGGGCTTCTTGACAAGCCAAAGGGCCACTGGTAGCTGTTGTGGACCG<br>AGCTGACCCTGCTGAAGTATTGTAGTGTGCCTTGGACCAACTTCTCAAAAGAGCAAC<br>CCCGGGGCTACCCTACTTCTGCCAGGAAGAGGCGGAGAAGGGGCTGAGAGGCCTGGA<br>AGGGGCTAGCTCCTTCTTTGAGAACTGCTCCCCGGAGGACTTGGAGGAGGCGGCTAG<br>GCTACGGGCTGCTGAGGGCCCTTTGTCTTTCCTAACCTGGGCACTGTTAGGATGCTC<br>CCTCCTGGAAAAGGCTTTCCTGGGTGTGAGCTAGAGCAGTGTCCATGCCAGCGCTGA<br>ACCTGCCATGGTGGGAGCTGAACTAAAAATTTCTCAGGGAACTAAAATAGGCAAAG<br>AGGAACTGGGGGAGGAGGGTGCCAGGCAGGATGGGGGAAGGGAGGGCAGTGCAAAA<br>GTCTCTTGAAACACAGACAGCCCAGCTGAGTGCCAGTCCCAGATCACAGAGAATACG<br>GCTCATCTGGCTCATGTTCTGCATGCTTGCTGCTTTACCCTGGCACTTTCCTTCTCC<br>ACCATGAGTGCGAGTCCTGGGAGTCCTGGGAGGGTGAGGATTAATGCCAGCCTGGGG<br>AGCAGATAGCTGACAGAGTCCTTGGGTAACTGGCTTGAACCAGGACCTCAGGATTCC<br>ACTCTGGGGATCTAGCTTTGTCTGGGCCAGTGAAGATCTCTATAATGGCATTATTGC<br>CAGGGGATAAACATTTCACTGGGTTCTGATCTGTTGGGTGTGGCTTCCTGGAAAATA<br>TGGTGAGAGGAATTCTGCTAAGGATACAGTTGATAAGAAAGTTCTGAGATTGATTAG<br>TAATGCCTGCCTTGGACTCAGGAAGGGAAGTGGCAGTATGAATGCCATGTCTTAATC<br>ATTTTGGTTAAAATATGCTTCCCAAAAGATTTCCACGTGTGTTCTTGTTTATTTGAC<br>ATCTGTCTCCATATCAGTCTTGAAAGCCTTTCTGTGTGTATATATATGATGTTTGCG<br>TGTATATATGTTTTTGTGTGTGCATATGGAAGTCAGAAATCACTGGGTGTCTTCCTC<br>CATTCCTTTGCAATGTATGTTTTTTTTTTTTTTACGATTTATTTACTATATGAATGT<br>TTTGCCTGAATACATGCATAGGTGTCACGTACATGCCTGCTGGAACGCTTGGAACTG<br>GAGTTACAGGTGGCTATGAGCTACAGTGTGAGCACTGGGAATCAAACCTGGGTCTTC<br>TGCAAGAGCAACAAATTAAAAGTCAGCTCTTAACTACTTGAGCTATTTTTCCAACTC<br>C (SEQ ID NO: 63)<br><br>>NP_083008.1 V-type immunoglobulin domain-containing<br>suppressor of T-cell activation isoform 1 precursor [*Mus musculus*]<br>MGVPAVPEASSPRWGTLLLAIFLAASRGLVAAFKVTTPYSLYVCPEGQNATLTCRIL<br>GPVSKGHDVTIYKTWYLSSRGEVQMCKEHRPIRNFTLQHLQHHGSHLKANASHDQPQ<br>KHGLELASDHHGNFSITLRNVTPRDSGLYCCLVIELKNHHPEQRFYGSMELQVQAGK<br>GSGSTCMASNEQDSDSITAAALATGACIVGILCLPLILLLVYKQRQVASHRRAQELV<br>RMDSSNTQGIENPGFETTPPFQGMPEAKTRPPLSYVAQRQPSESGRYLLSDPSTPLS<br>PPGPGDVFFPSLDPVPDSPNSEAI (SEQ ID NO: 64) |
| Human B7-H7<br>(HHLA2) | >NM_007072.4 *Homo sapiens* HERV-H LTR-associating 2<br>(HHLA2), transcript variant 1, mRNA<br>AGTTCTCTTCAAGTCATGTAATCGACTTTTTTGAATTAGTTTTCAGTTTCATTTTGT<br>TTTCCCTAATTCAAGTTGGGAACACTTCATTTTCCCCAATTCAAGTTGGGAACACTT<br>CCTTGGTATTTCCTTGCTACATGGACTTTAGCAAATGCTACTTTACTCTCCTTCCAG<br>CTACTCAGGAGGCTGAGGCAGGAGAATCGCTTGAACCCGGGAGGCGGAGGTTACAGT<br>GAGCCTTTTCCTAGTTTTACTGTTGGAAGCCTAACTCACAGGAGAGATTATGCAATA<br>CAGTCCTGAAGTCAAGGGAGGAGAGCATGTAGGAGAATACTAACCCTGCACAGATTG<br>TGATGGTGATGTGGAATATACTAAAGCCTAGAACGCACCTCCTCTGCATGACTAATA<br>TGTTCTGCACAAGACATGAAGGCACAGACAGCACTGTCTTTCTTCCTCATTCTCATA<br>ACATCTCTGAGTGGATCTCAAGGCATATTCCCTTTGGCTTTCTTCATTTATGTTCCT<br>ATGAATGAACAAATCGTCATTGGAAGACTTGATGAAGATATAATTCTCCCTTCTTCA<br>TTTGAGAGGGGATCCGAAGTCGTAATACACTGGAAGTATCAAGATAGCTATAAGGTT<br>CACAGTTACTACAAAGGCAGTGACCATTTGGAAAGCCAAGATCCCAGATATGCAAAC<br>AGGACATCCCTTTTCTATAATGAGATTCAAATGGGAATGCGTCGCTATTTTTCAGA<br>AGAGTAAGCCTTCTGGACGAAGGAATTTACACCTGCTATGTAGGAACAGCAATTCAA<br>GTGATTACAAACAAAGTGGTGCTAAAGGTGGGAGTTTTTCTCACACCCGTGATGAAG<br>TATGAAAAGAGGAACACAAACAGCTTCTTAATATGCAGCGTGTTAAGTGTTTATCCT<br>CGTCCAATTATCACGTGGAAAATGGACAACACACCTATCTCTGAAAACAACATGAAA<br>GAAACAGGGTCTTTGGATTCTTTTTCTATTAACAGCCCACTGAATATTACAGGATCA<br>AATTCATCTTATGAATGTACAATTGAAAATTCACTGCTGAAGCAAACATGGACAGGG |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | CGCTGGACGATGAAAGATGGCCTTCATAAAATGCAAAGTGAACACGTTTCACTCTCA<br>TGTCAACCTGTAAATGATTATTTTTCACCAAACCAAGACTTCAAAGTTACTTGGTCC<br>AGAATGAAAAGTGGGACTTTCTCTGTCCTGGCTTACTATCTGAGCTCCTCACAAAAT<br>ACAATTATCAATGAATCCCGATTCTCATGGAACAAAGAGCTGATAAACCAGAGTGAC<br>TTCTCTATGAATTTGATGGATCTTAATCTTTCAGACAGTGGGGAATATTTATGCAAT<br>ATTTCTTCGGATGAATATACTTTACTTACCATCCACACAGTGCATGTAGAACCGAGC<br>CAAGAAACAGCTTCCCATAACAAAGGCTTATGGATTTTGGTGCCCTCTGCGATTTTG<br>GCAGCTTTTCTGCTGATTTGGAGCGTAAAATGTTGCAGAGCCCAGCTAGAAGCCAGG<br>AGGAGCAGACACCCTGCTGATGGAGCCCAACAAGAAAGATGTTGTGTCCCTCCTGGT<br>GAGCGCTGTCCCAGTGCACCCGATAATGGCGAAGAAAATGTGCCTCTTTCAGGAAAA<br>GTATAGGAAATGAGAGAAGACTGTGACAACTCATGACCTGCATCCTTAATATCCAGT<br>GACTTCATCTCCCCTTTCTTCACCACAATTCCAGGCAATGGCCTGTCGGAGCAGACA<br>ATTCTACCACTGCAAAGAGTTGTAACCATTTTCTGGTATCACATTTATTTTTCAAGA<br>CATACTTTTCAAGACATCATTCACTGACCCACTACCTGCATTGAGTATAAATGCCTG<br>GATGTTAAGGATTCCAATTTAACTTTGAAAAGAACTGTCTCATTCATTTACATTTCT<br>GTTACAGTCAGCCCAGGAGGTTACAGTGAGCTCTCCACTAAGAATCTGGAAGAAATG<br>CATCACTAGGGGTTGATTCCCAATCTGATCAACTGATAATGGGTGAGAGAGCAGGTA<br>AGAGCCAAAGTCACCTTAGTGGAAAGGTTAAAAACCAGAGCCTGGAAACCAAGATGA<br>TTGATTTGACAAGGTATTTTAGTCTAGTTTTATATGAACGGTTGTATCAGGGTAACC<br>AACTCGATTTGGGATGAATCTTAGGGCACCAAAGACTAAGACAGTATCTTTAAGATT<br>GCTAGGGAAAAGGGCCCTATGTGTCAGGCCTCTGAGCCCAAGCCAAGCATCGCATCC<br>CCTGTGATTTGCACGTATACATCCAGATGGCTAAAGTAACTGAAGATCCACAAAAG<br>AAGTAAAAATAGCCTTAACTGATGACATTCCACCATTGTGATTTGTTCCTGCCCCAC<br>CCTAACTGATCAATGTACTTTGTAATCTCCCCCACCCTTAAGAAGGTACTTTGTAAT<br>CTTCCCCACCCTTAAGAAGGTTCTTTGTAATTCTCCCCACCCTTGAGAATGTACTTT<br>GTGAGATCCACCCTGCCCACAAAACATTGCTCTTAACTTCACCGCCTAACCCAAAAC<br>CTATAAGAACTAATGATAATCCATCACCCTTCGCTGACTCTCTTTTCGGACTCAGCC<br>CACCTGCACCCAGGTGAAATAAACAGCTTTATTGCTCACACAAA (SEQ ID NO: 65)<br><br>>NP_009003.1 HERV-H LTR-associating protein 2 isoform a precursor [Homo sapiens]<br>MKAQTALSFFLILITSLSGSQGIFPLAFFIYVPMNEQIVIGRLDEDIILPSSFERGS<br>EVVIHWKYQDSYKVHSYYKGSDHLESQDPRYANRTSLFYNEIQNGNASLFFRRVSLL<br>DEGIYTCYVGTAIQVITNKVVLKVGVFLTPVMKYEKRNTNSFLICSVLSVYPRPIIT<br>WKMDNTPISENNMEETGSLDSFSINSPLNITGSNSSYECTIENSLLKQTWTGRWTMK<br>DGLHKMQSEHVSLSCQPVNDYFSPNQDFKVTWSRMKSGTFSVLAYYLSSSQNTIINE<br>SRFSWNKELINQSDFSMNLMDLNLSDSGEYLCNISSDEYTLLTIHTVHVEPSQETAS<br>HNKGLWILVPSAILAAFLLIWSVKCCRAQLEARRSRHPADGAQQERCCVPPGERCPS<br>APDNGEENVPLSGKV (SEQ ID NO: 66 |
| Mouse BTNL1 | >NM_001111094.1 Mus musculus butyrophilin-like 1 (Btnl1), mRNA<br>ACCCTTAAATAAGAGCTGAAGATGGCTGCAGCTTTCTCCTAGACTCCTCCAGGAGAA<br>ACTCTAAAGCCAGAGCCTGGGGGCAGCATTGTGTGTCCACCTTGCCACTGAGAACAT<br>CTACGGAAATTGGACACTCTGGCCCCAGCATCCACACGCTTGACTGTTGGCCACAGT<br>AACACAGGTGTGGATGGTCCCCAGAGCCAGGGTCCAGGAGTGCACTGAGGATCCCTG<br>GGGCTTCAAGGAACCCACAGCTCTGTCCAGACGGGAATTTTTTCCTGAGAACTTTC<br>ACCTGTTGCCCTCCTATGGTGAACCTGGACTTGACCTTCCACTCTGATGATGAAGGG<br>CTCCCCCTCCGTCCCTCCAGCTGGTTGTCTCCTCCCTCTGCTCCTCCTGCTGTTTAC<br>CGGAGTCTCTGGAGAAGTGTCTTGGTTTTCTGTGAAGGGACCAGCTGAGCCCATCAC<br>TGTCCTGCTGGGGACTGAAGCCACCCTGCCCTGCCAGCTGTCTCCTGAACAGAGTGC<br>AGCTCGCATGCACATCCGATGGTACCGTGCCCAGCCCACCCCTGCTGTGCTGGTGTT<br>CCACAACGGACAGGAGCAGGGAGAGGTGCAGATGCCGGAATACAGGGGCAGGACCCA<br>GATGGTGAGACAAGCCATTGACATGGGAAGTGTGGCTCTGCAGATACAGCAGGTCCA<br>GGCCTCTGATGATGGCCTGTACCACTGTCAGTTTACAGATGGCTTCACCTCCCAAGA<br>GGTCTCCATGGAGCTTCGAGTCATAGGTTTAGGCTCTGCCCCTCTTGTTCACATGAC<br>AGGACCTGAGAATGATGGGATCCAGTGTTGTGCTCCTCAAGTGGCTGGTTCCCAAA<br>ACCCAAAGTGCAATGGAGAGACACCTCCGGGAACATGCTACTGTCCTCCTCTGAGTT<br>GCAGACCCAAGACAGAAGGGCTCTTCCAGGTGGAAGTGTCTCTTTTGGTCACAGA<br>TAGAGCTATTGGCAATGTGATCTGCTCCATCCAAAATCCCATGTATGACCAGGAGAA<br>ATCGAAGGCCATCCTCCTCCCAGAGCCCTTCTTCCCCAAGACGTGTCCATGGAAAGT<br>AGCCCTGGTTTGTTCTGTCCTCATACTATTGGTCCTGCTCGGTGGGATCAGCCTTGG<br>AATCTGGAAAGAACATCAAGTCAAAAGGAGAGAAATTAAAAAATGGTCAAAGGAACA<br>TGAAGAAATGCTTCTGTTGAAGAAGGGGACAAAATCTGTACTGAAGATCAGAGATGA<br>CCTCCAGGCCGACCTAGATCGGAGGAAGGCGCTGTACAAAGAAGACTGGAAGAAGGC<br>CTTGCTGTACCCTGACTGGAGGAAGGAGCTGTTCCAGGAGGCTCCTGTGAGGATAAA<br>TTATGAAATGCCTGACCAGGACAAGACAGACTCAAGGACAGAAGAGAACAGAGGTGA<br>GGGAGACTGTCAGCAGCTCACAAGTAGACCACAACCTCATCACACTCTCCCAGGAAGG<br>CTTCATGTTGGGAAGATACTACTGGGAGGTGGATGTCAAGGACACAAGGGAGTGGAC<br>ACTAGGAGTTTATGAGCTGTGCACTCAGGATGCATCACTTACAGACCCCTTGAGGAA<br>ATTCAGAGTCCTGGAAAAGAATGGAGATGGATACAGGGCTCTTGACTTCTGTTCCCA<br>AAACATTAATTCGGAAGAACCTCTGCAACTGAAGACACGTCCGCTGAAGATCGCCAT<br>CTTCTTGGATCAGGAAGACAATGACCTCTCTTTCTACAACATGACCGATGAGACACA<br>CATCTTTTCCTTTGCCCAGGTCCCTTTCTTGGGATCACCCTATCCTTACTTCACACG |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | TAATTCCATGGGGCTCTCTGCAACAGCACAGCCCTAAGTGATGTGCACAGGGAATTC<br>AATGGGTGGGTGCTGCAGCGTGCTACCCGTAAGGCCCTCTTAGGCAGGCACAGGGGG<br>CCTCTGACCAAGAGGCCTCTTAACCTGAGACTCCATGAGCCTCGGGGATCAGATCCT<br>GGACAAGATTCTCGGACCATCTGTGTCGTGCATGGTGTTATAGTTATTAATAGCCTT<br>CCTTCTTTTGACAAAAATGTGTTTAATCATTCCTAAGATAAATGAATCCATGGCTTT<br>CTGA (SEQ ID NO: 67)<br><br>>NP_001104564.1 butyrophilin-like protein 1 precursor<br>[Mus musculus]<br>MMKGSPSVPPAGCLLPLLLLLFTGVSGEVSWFSVKGPAEPITVLLGTEATLPCQLSP<br>EQSAARMHIRWYRAQPTPAVLVFHNGQEQGEVQMPEYRGRTQMVRQAIDMGSVALQI<br>QQVQASDDGLYHCQFTDGFTSQEVSMELRVIGLGSAPLVHMTGPENDGIRVLCSSSG<br>WFPKPKVQWRDTSGNMLLSSSELQTQDREGLFQVEVSLLVTDRAIGNVICSIQNPMY<br>DQEKSKAILLPEPFFPKTCPWKVALVCSVLILLVLLGGISLGIWKEHQVKRREIKKW<br>SKEHEEMLLLKKGTKSVLKIRDDLQADLDRRKALYKEDWKKALLYPDWRKELFQEAP<br>VRINYEMPDQDKTDSRTEENRGEETVSSSQVDHNLITLSQEGFMLGRYYWEVDVKDT<br>EEWTLGVYELCTQDASLTDPLRKFRVLEKNGDGYRALDFCSQNINSEEPLQLKTRPL<br>KIAIFLDQEDNDLSFYNMTDETHIFSFAQVPFLGSPYPYFTRNSMGLSATAQP<br>(SEQ ID NO: 68) |
| Human VSIG8 | >NM_001013661.1 Homo sapiens V-set and immunoglobulin domain containing 8 (VSIG8), mRNA<br>ACTCATTGCACCTTCCTGCCACCCCAGGCAGTGTCTGGGCCCTCAGCTCCCCCTCCC<br>TCCACCTACCCCCTCACACCCACCACTACGACCCCACGGGATACCCAGCCCAGACGG<br>AGGAAACACCGAGCCTAGAGACATGAGAGTTGGAGGAGCATTCCACCTTCTACTCGT<br>GTGCCTGAGCCCAGCACTGCTGTCTGCTGTGCGGATCAACGGGGATGGACAGGAGGT<br>CCTGTACCTGGCAGAAGGTGATAATGTGAGGCTGGGCTGCCCCTACGTCCTGGACCC<br>TGAGGACTATGGTCCCAATGGGCTGGACATCGAGTGGATGCAGGTCAACTCAGACCC<br>CGCCCACCACCGAGAGAACGTGTTCCTTAGTTACCAGGACAAGAGGATCAACCATGG<br>CAGCCTTCCCCATCTGCAGCAGAGGGTCCGCTTTGCAGCCTCAGACCCAAGCCAGTA<br>CGATGCCTCCATCAACCTCATGAACCTGCAGGTATCTGATACAGCCACTTATGAGTG<br>CCGGGTGAAGAAGACCACCATGGCCACCCGGAAGGTCATTGTCACTGTCCAAGCACG<br>ACCTGCAGTGCCCATGTGCTGGACAGAGGGCCACATGACATATGGCAACGATGTGGT<br>GCTGAAGTGCTATGCCAGTGGGGGCTCCCAGCCCCTCTCCTACAAGTGGGCCAAGAT<br>CAGTGGGCACCATTACCCCTATCGAGCTGGGTCTTACACCTCCCAGCACAGCTACCA<br>CTCAGAGCTGTCCTACCAGGAGTCCTTCCACAGCTCCATAAACCAAGGCCTGAACAA<br>TGGGGACCTGGTGTTGAAGGATATCTCCAGAGCAGATGATGGGCTGTATCAGTGCAC<br>AGTGGCCAACAACGTGGGCTACAGTGTTTGTGTGGTGGAGGTGAAGGTCTCAGACTC<br>CCGGCGTATAGGCGTGATCATCGGCATCGTCCTGGGCTCTCTGCTCGCGCTGGGCTG<br>CCTGGCCGTAGGCATCTGGGGGCTCGTCTGCTGCTGCTGCGGGGGCTCCGGGGCTGG<br>CGGCGCCCGCGGTGCCTTCGGCTACGGCAACGGCGGCGGGGTCGGCGGAGGGGCCTG<br>CGGCGACTTGGCTAGTGAGATCAGAGAGGACGCCGTGGCGCCCGGGTGCAAGGCCAG<br>CGGGCGCGGCAGCCGCGTCACCCACCTCCTGGGGTACCCGACGCAGAACGTCAGCCG<br>CTCCCTGCGCCGCAAGTACGCGCCTCCCCCCTGCGGCGGCCCCGAGGACGTGGCCCT<br>GGCGCCCTGCACCGCCGCCGCCGCCTGCGAAGCGGGCCCCTCCCCGGTCTACGTCAA<br>GGTCAAGAGCGCGGAGCCGGCTGACTGCGCCGAGGGGCCGGTGCAGTGCAAGAACGG<br>CCTCTTGGTGTGAGCGCGCGCGCCGGGCCGGGCTGCGCCCCAGCCAGGAGGAGGGCG<br>CGGGGCTCTCTGTCTGCAGCTGGGGACACGTCGGGGCTGGGGACGACCTCGCTCGCC<br>CCAGGCTGCCAGGCGGCTGGGGGTGAAGGCATTTCCCTAAGGAAATGCGTAGGGAGG<br>CAGAGCCTCCTCCCCAAAAGTGGGAAGGGCGGGCGAGGGCGGAGGAAGGCGATCCT<br>GAGCCTTCTCCGCACCCCCGGGACCGAAGGCTTGGGGGAGGGAGGGAGGAGGAGGAGG<br>CTGAGTGTCCTAGAGCGGCTGAGGCCGGAGGCCTGGTGTCCCCAGCCTAAGCAGAGG<br>GCCCCGGGGCCGGGTGGGTGGGGGTCTGTCTGGACGAATTGTTCTGTGTGTGAGGT<br>CTGAGCTCTGAGGCAGCAGTGTTAGCACAATAAAGAAACATTGAGACGTGA (SEQ<br>ID NO: 69)<br><br>>NP_001013683.1 V-set and immunoglobulin domain-containing protein 8 precursor [Homo sapiens]<br>MRVGGAFHLLLVCLSPALLSAVRINGDGQEVLYLAEGDNVRLGCPYVLDPEDYGPNG<br>LDIEWMQVNSDPAHHRENVFLSYQDKRINHGSLPHLQQRVRFAASDPSQYDASINLM<br>NLQVSDTATYECRVKKTTMATRKVIVTVQARPAVPMCWTEGHMTYGNDVVLKCYASG<br>GSQPLSYKWAKISGHHYPYRAGSYTSQHSYHSELSYQESFHSSINQGLNNGDLVLKD<br>ISRADDGLYQCTVANNVGYSVCVVEVKVSDSRRIGVIIGIVLGSLLALGCLAVGIWG<br>LVCCCCGGSGAGGARGAFGYGNGGGVGGGACGDLASEIREDAVAPGCKASGRGSRVT<br>HLLGYPTQNVSRSLRRKYAPPPCGGPEDVALAPCTAAAACEAGPSPVYVKVKSAEPA<br>DCAEGPVQCKNGLLV (SEQ ID NO: 70) |
| Mouse VSIG8 | >NM_177723.4 Mus musculus V-set and immunoglobulin domain containing 8 (Vsig8), transcript variant 1, mRNA<br>ACTCATTGCATCTTCCTGCCACCCCGGGCAGTGTCTGGGCCCTCAGCTCCCCCTCCC<br>TCCACCTGCCCCTTCCACCCACCACCACCAGCCCACTGGAGCCCAGCTCAGGCGGAG<br>GAAAGACCAAGCCTAGAGACATGGGAGTTCGAGGAGCACTCCATCTTCTACTTGTGT<br>GCCTGAGCCCAGCACTGTTGTCTGCTGTAAGGATCAACGGGGATGGCCAGGAGGTCA<br>TGTACCTGGCAGAAGGTGACAATGTGAGGCTAGGCTGTCCCTACCTCCTGGATCCTG<br>AGGATTTGGGTACCAACAGTCTGGACATTGAGTGGATGCAAGTCAACTCAGAGCCCT |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | CACACAGGGAGAATGTTTTCTTACTTATCAAGACAAGAGGATAGGTCATGGCAACC<br>TCCCCCATCTGCAGCAGAGGGTCCGCTTTGCAGCCTCAGACCCCAGCCAGTACGATG<br>CCTCCATCAACCTCATGAACCTGCAGGTATCTGACACAGCAACCTATGAGTGCCGGG<br>TGAAGAAGACCACCATGGCCACCAGGAAGGTCATTGTCACTGTCCAAGCACGTCCTG<br>CGGTGCCCATGTGTTGGACGGAAGGCCACATGTCAAAGGGCAACGATGTGGTGCTGA<br>AGTGCTTTGCCAACGGAGGCTCTCAGCCCCTCTCCTACAAGTGGGCCAAGATCAGTG<br>GGCACAGTCACCCCTACCGAGCTGGGGCTTACCACTCACAGCACAGCTTCCACTCTG<br>AGCTTTCTTACCAAGAGTCATTCCACAGCACCATCAACCAAGGCCTGGGCAACGGAG<br>ACCTGCTGTTGAAGGGCATCAACGCAGACGACGATGGGCTGTATCAGTGCACAGTGG<br>CCAACCATGTGGGCTACAGCGTCTGTGTGGTAGAGGTGAAAGTCTCAGACTCCCAGC<br>GAGTAGGCATGATCGTTGGAGCAGTGCTGGGCTCTTTGCTCATGCTGGCCTGCCTGG<br>CACTAGGCATCTGGGGGCTCATCTGCTGCTGCTGCGGAGGCGGCGGGGCCGGTGGTG<br>CCCGAGGTGCCTTCGGCTACGGGGTCGGCGGCGGGGTCGGCGGAGGGGCCTGCGGCG<br>ACTTGGCTAGTGAGATCAGAGTGGACGCCGAGGCGCCCGGGTGTAAGGCCAGCGGGC<br>GCGGCAGCCGCGTCACCCACCTCCTGGGGTACCCGACGCAGAACGTCAGCCGCTCCC<br>TGCGCCGCAAGTACGCGCCTCCGCCCTGCGGCGGCCCCGAGGACGTGGCCCTAGTGC<br>CCCGCACCGCCTCCGCCTCCTGCGAAGCGGGTCCCTCCCCCGTCTACATCAAGGTCA<br>AGAGCGCGGAGCCGGCCGACTGCGCCGACTGTGCCCAGGTCGAGCAGCGCTCGTGCA<br>AGGACGGCCTCTTAGTGTGAGCGCACAGCACCGGGCTGCGCCCCGGCTGGGAGGTGG<br>TTCGGGGGCTCTCTGCCCGCAGCTGGGGACAGGTTCGGGCCAGCAGACCTGGCTCTC<br>TCATTGGCCACCTAGCGGTGGTAAGGAAATTTCCCTCTGAGAAGCCAAGCCGGGCAG<br>ACCCTCCTCCCCTGTAGTGGGAGGAGAGGCGGGGGAGACAGAAAACAGTTCAGAGCT<br>CTCCCTCACCCCTGGTTTCCAGGGAGAGGAAGGGAGAGGAGAGCTGTCGGTATCCCA<br>GAACCGCAGAGGTACAACCCAGATGTCCCCAGCCAAGGCGAGGGCCCCCAGCCCTG<br>GGTAGGTGGATGTCAGGGCTGAATTGCTCTGTGTGTGAGATCTGAGCTCCAAGGCAA<br>CAGTGTTAGCACAATAAAGAAACTTAAAGACTGAAAAAAAAAAAAA (SEQ ID NO: 71)<br><br>>NP_808391.2 V-set and immunoglobulin domain-containing protein 8 precursor [Mus musculus]<br>MGVRGALHLLLVCLSPALLSAVRINGDGQEVMYLAEGDNVRLGCPYLLDPEDLGTNS<br>LDIEWMQVNSEPSHRENVFLTYQDKRIGHGNLPHLQQRVRFAASDPSQYDASINLMN<br>LQVSDTATYECRVKKTTMATRKVIVTVQARPAVPMCWTEGHMSKGNDVVLKCFANGG<br>SQPLSYKWAKISGHSHPYRAGAYHSQHSFHSELSYQESFHSTINQGLGNGDLLLKGI<br>NADDDGLYQCTVANHVGYSVCVVEVKVSDSQRVGMIVGAVLGSLLMLACLALGIWGL<br>ICCCCGGGGAGGARGAFGYGVGGGVGGGACGDLASEIRVDAEAPGCKASGRGSRVTH<br>LLGYPTQNVSRSLRRKYAPPPCGGPEDVALVPRTASASCEAGPSPVYIKVKSAEPAD<br>CADCAQVEQRSCKDGLLV (SEQ ID NO: 72) |
| Human VSIG3 (ISF11) | >NM_001015887.3 Homo sapiens immunoglobulin superfamily member 11 (IGSF11), transcript variant 2, mRNA<br>AGTCCTGGGGCAGGGCTGGGTGGCACGGCTGGCGAGCCCGGAACGCCTCTGGTCACA<br>GCTCAGCGTCCGCGGAGCCGGGCGGCGCTGCAGCTGCACTTGGCTCGTCTGTGGGTC<br>TGACAGTCCCAGCTCTGCGCGGGGAACAGCGGCCCGGCGCTGGGTGTGGGAGGACCA<br>GGCTGCCCCAAGAGCGCGGAGACTCACGCCCGCTCCTCTCCTGTTGCGACCGGGAGC<br>CGGGTAGGAGGCAGGCGCGCTCCCTGCGGCCCCGGGATGACTTCTCAGCGTTCCCCT<br>CTGGCGCCTTTGCTGCTCCTCTCTCTGCACGGTGTTGCAGCATCCCTGGAAGTGTCA<br>GAGAGCCCTGGGAGTATCCAGGTGGCCCGGGGTCAGCCAGCAGTCCTGCCCTGCACT<br>TTCACTACCAGCGCTGCCCTCATTAACCTCAATGTCATTTGGATGGTCACTCCTCTC<br>TCCAATGCCAACCAACCTGAACAGGTCATCCTGTATCAGGGTGGACAGATGTTTGAT<br>GGTGCCCCCCGGTTCCACGGTAGGGTAGGATTTACAGGCACCATGCCAGCTACCAAT<br>GTCTCTATCTTCATTAATAACACTCAGTTATCAGACACTGGCACCTACCAGTGCCTG<br>GTCAACAACCTTCCAGACATAGGGGGCAGGAACATTGGGGTCACCGGTCTCACAGTG<br>TTAGTTCCCCCTTCTGCCCCACACTGCCAAATCCAAGGATCCCAGGATATTGGCAGC<br>GATGTCATCCTGCTCTGTAGCTCAGAGGAAGGCATTCCTCGACCAACTTACCTTTGG<br>GAGAAGTTAGACAATACCCTCAAACTACCTCCAACAGCTACTCAGGACCAGGTCCAG<br>GGAACAGTCACCATCCGGAACATCAGTGCCCTGTCTTCAGGTTTGTACCAGTGCGTG<br>GCTTCTAATGCTATTGGAACCAGCACCTGTCTTCTGGATCTCCAGGTTATTTCACCC<br>CAGCCCAGGAACATTGGACTAATAGCTGGAGCCATTGGCACTGGTGCAGTTATTATC<br>ATTTTTTGCATTGCACTAATTTTAGGGGCATTCTTTTACTGGAGAAGCAAAAATAAA<br>GAGGAGGAAGAAGAAGAAATTCCTAATGAAATAAGAGAGGATGATCTTCCACCCAAG<br>TGTTCTTCTGCCAAAGCATTTCACACTGAGATTTCCTCCTCGGACAACAACACACTA<br>ACCTCTTCCAATGCCTACAACAGTCGATACTGGAGCAACAATCCAAAAGTTCATAGA<br>AACACAGAGTCAGTCAGCCACTTCAGTGACTTGGGCAATCTTTCTCTTTCCACTCA<br>GGCAATGCCAACATACCATCCATTTATGCTAATGGGACCCATCTGGTCCCGGGTCAA<br>CATAAGACTCTGGTAGTGACAGCCAACAGAGGGTCATCACCCACAGGTGATGTCCAGG<br>AGCAATGGCTCAGTCAGTAGGAAGCCTCGGCCTCCACACACTCATTCCTACACCATC<br>AGCCACGCAACACTGGAACGAATTGGTGCAGTACCTGTCATGGTACCAGCCCAGAGT<br>CGGGCCGGGTCCTTGGTATAGGACATGAGGAAATGTTGTGTTCAGAAATGAATAAAT<br>GGAATGCCCTCATACAAGGGGGAAGGTTGGGGTGGGGAGTGCTGGGAAGAAACACTT<br>CCTTATAATTATATTAGTAAAATGCACAAAGAAGAAGGCAGTGCTGTTACTTGGCCA<br>CTAAGATGTGTAAAATGGACTGAAATGCTCCATCATGAAGACTTGCTTCCCCACCAA<br>AGATGTCCTGGGATTCTGCTGGATCTCAAAGATGTGCCAAGCCAAGGAAAAAGATAC<br>AAGAGCAGAATAGTACTTAAAATCCAAACTGCCGCCCAGATGGGCTTGTTCTTCATG<br>CCTAACTTAATAATTTTTAAGAGATTAAAGTGCCAGATGGAGTTTAAATATTGAAAT |

TABLE 1-continued

Type I Proteins of Interest Amino Acid Sequence

| Protein of Interest | Transcript Sequence (SEQ ID NO:)<br>Amino Acid Sequence (SEQ ID NO:) |

TATTTTAAAAGGTAGGTGTCTTTAAGAAAATAACAAGCAACCCTGTGATATGTTCCG
TCTCTCCCAATTCCCTCGTTATATAGAGGGCTTAATGGTATAAATGGTTAATATTGG
TCCCAACAGGGCTGACTCTTCTATCATATAATCAAAACTTTTTTACATGAGCAAAATT
CAGTAAGAAATGGGGGAAGACAAAGGAAACGTCTTTGAGAAGCCCCTTCATATTTAT
TTATTTATCTCTTCCTGAACCATGAATTTCATATGTGGAATATTGCTATATTGACAG
ATTCTTGCCTGTCTGTGTTATTCTAGGATCTGTTACAGGTCCATGGCAATTACTGTT
TATTTTTTCCTGGAAAAATATTTTTTTATAAAAGGCTTTTTTTTTTTTTAAATACA
TGAGAGGCATTGGGCTAAGAAAGAAAAGACTGTTGTATAATACCTTGTTCAATGGTT
GTATTTAGTGAGCTCATAGAGGTCCATCATATCATGACCGAGCTAGGTTGTGTGGGC
AGGAAGGTAGGGCTAAGGGGTTGTAGCCTTGCTGGGCAGCCTCTCAGAGCAAGGTTG
TTCAGATCTCCCTTGCTATTACAGTAGGTTACTATTAATGAGGGCAGCACCTGATGC
CTTTTGTACTGAGGTATGTAACTTTCTCCTTATTTGACAAGTAGAAGTTAACTTACT
TGTCAGGGAGGGCAGACGTTTTTTGTTCTGTTTCGTTTTTCAAAATAATGCTTTTT
GCAAAAGAGGTAAGACTGAGACTAAAGGTGTTATCTTCTGGTGTGCTCCTGGAAGTG
TCTACCCTACATTTGTGTCAGCTCAGGGTTGCAGTGTTGCCCAGATGCATTTTACAT
CACTGTAAAGAGATTACTTTTGTGGTTACTACCTGGCTTGGCTGGCCTTGCGGTTCA
CCAGATTAATTTACAAACTCCCCCACTTTATTTTGTGCTATGTAGATCTGGCCATAC
TTGCATTAGTGACTGTCTTGCCTTAACCACACTTAAGCAACCCACAAATTTCTTCTC
AGATTTGTTTCCTAGATTACTTATGATACTCATCCCATGTCTCAATAAGAGTGTCTT
TTCTTTCTGGATGTGTTCTCTTACTCCCTCTTACCACCATACTTTTTGCTCTCTTCT
CCTGCAAGCGTAGTCTTCACAGGGAGTGGCTTCCTGACATTTTTTTCAGTTATGTGA
ATGAATGGAAACCAACAGCTGCTGCAAACACTGTTTTTCCAAGAAGGCTACACTCAG
AACCTAACCATTGCCAACCATTTCAGTATTGATAAAAAGCTGAATTTACTTTAGCAT
TACTTATTTTTTTTCCATTTGATGGTTCTTACTTTGTAAAAATTTAAATAAATGAA
TGTCTATACTTTTTATAAAGAAAAGTGAAAATACCATGACACTGAAAAGATGATGCT
ATCAGATGCTGTTTAGAAAGCATTTATCTTGCATTTCTTTATTCTTTCTAATTATCT
AAAATTCAATAAAATTTTATTCATATAAAATAAGTTGTCATTAATTATCAATACTAA
CGAGTATGTCATTTTAAAACTTAGTATTCTCTTTAATGTTACAAGA (SEQ ID
NO: 73)

>NP_001015887.1 immunoglobulin superfamily member 11
isoform b precursor [Homo sapiens]
MTSQRSPLAPLLLLSLHGVAASLEVSESPGSIQVARGQPAVLPCTFTTSAALINLNV
IWMVTPLSNANQPEQVILYQGGQMFDGAPRFHGRVGFTGTMPATNVSIFINNTQLSD
TGTYQCLVNNLPDIGGRNIGVTGLTVLVPPSAPHCQIQGSQDIGSDVILLCSSEEGI
PRPTYLWEKLDNTLKLPPTATQDQVQGTVTIRNISALSSGLYQCVASNAIGTSTCLL
DLQVISPQPRNIGLIAGAIGTGAVIIIFCIALILGAFFYWRSKNKEEEEEIPNEIR
EDDLPPKCSSAKAFHTEISSSDNNTLTSSNAYNSRYWSNNPKVHRNTESVSHFSDLG
QSFSFHSGNANIPSIYANGTHLVPGQHKTLVVTANRGSSPQVMSRSNGSVSRKPRPP
HTHSYTISHATLERIGAVPVMVPAQSRAGSLV (SEQ ID NO: 74)

| Mouse VSIG3<br>(IGSF11) | >NM_170599.2 Mus musculus immunoglobulin superfamily,<br>member 11 (Igsf11), mRNA |

CGGCTGGTGGTGGCCGCGGCGGCCGGCGAGCCCGGGACGCCCGAGCCTGCCCCGAGC
CTCGGCGGAGCGGAGTGGCCTCGGCGCTCCCGTGTCCCGCTTGGTCCCACGCTGCAC
CCCGCCGCCCAGGAGCCCGGCGGACGGCGGCTCCCCGGCGGCTCCGGCATGACTCG
GCGGCGCTCCGCTCCGGCGTCCTGGCTGCTCGTGTCGCTGCTCGGTGTCGCAACATC
CCTGGAAGTGTCCGAGAGCCCAGGCAGTGTCCAGGTGGCCCGGGGCCAGACAGCAGT
CCTGCCCTGCGCCTTCTCCACCAGTGCTGCCCTCCTGAACCTCAATGTCATTTGGAT
GGTCATTCCCCTCTCCAATGCAAACCAGCCCGAACAGGTCATTCTTTATCAGGGTGG
ACAAATGTTTGACGGCGCCCTCCGGTTCCACGGGAGGGTAGGATTTACCGGCACCAT
GCCTGCTACCAATGTCTCGATCTTCATCAATAACACACAGCTGTCAGATACGGGCAC
GTACCAGTGCTTGGTGAATAACCTTCCAGACAGAGGGGGCAGAAACATCGGGGTCAC
TGGCCTCACAGTGTTAGTCCCCCCTTCTGCTCCACAATGCCAAATCCAAGGATCCCA
GGACCTCGGCAGTGACGTCATCCTTCTGTGTAGTTCAGAGGAAGGCATCCCTCGGCC
CACGTACCTTTGGGAGAAGTTAGATAATACGCTCAAGCTACCTCCAACAGCCACTCA
GGACCAGGTCCAGGGAACAGTCACCATCCGGAATATCAGTGCCCTCTCTTCCGGTCT
GTACCAGTGTGTGGCTTCTAATGCCATCGGGACCAGCACCTGTCTGCTGGACCTCCA
GGTTATCTCACCCCAGCCCCGGAGCGTTGGAGTAATAGCCGGAGCGGTTGGCACCGG
TGCTGTTCTTATCGTCATCTGCCTTGCACTAATTTCAGGGGCGTTCTTTTACTGGAG
AAGCAAAAACAAAGAGGAGGAGGAGGAAGAAATTCCTAATGAAATCAGAGAGGATGA
TCTTCCCCCTAAATGCTCTTCTGCCAAAGCCTTCCACACGGAGATATCCTCCTCAGA
AAATAACACGCTGACCTCTTCCAATACCTACAACAGTCGATACTGGAACAACAATCC
AAAACCCCATAGAAACACAGAGTCTTTCAACCACTTCAGTGACTTACGCCAGTCTTT
CTCTGGCAATGCAGTTATCCCATCAATCTATGCAAATGGGAACCATCTGGTTTTGGG
TCCACATAAGACTCTGGTAGTTACAGCCAACAGAGGGTCATCACCTCAGGTCTTGCC
CAGGAACAATGGTTCAGTCAGCAGGAAGCCTTGGCCTCAACACACTCATTCCTACAC
AGTAAGCCAAATGACCCTGGAGCGCATCGGTGCAGTGCCTGTCATGGTGCCTGCCCA
GAGTCGAGCAGGGTCCCTGGTATAGGATGACTGAGGAAACCATGTTCAGAAGAGAAT
AAATGGACCGCCTTCAGGCAAGGGGGGAGCACTGCCTTCAGGCAAGAGGGAGTGGGATGGGTGAGTGCTGAAAAATAAACTTTTGTTA
CGATTCCATTAGCAAAAAGCACAAAGAGGAGGCGTGTGAAGTGGCCTGGGGTTGT
TCCATAATGAAGACTCAAGAAGACTGTTTCCCCACCACAGATGTCCTGAGATTCAGT
TAAAACGAAACATGCTGCATCTCCAGAGATGTGCCAAGCAAGGAGAATGCTAGAAG
CAGAGTAAAGCTTACCCCCCAAACTGTGGTCCAGCTGGACCCCTTCTTTAATTCTTG

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | CCTAACTTAATTATTTTCAGGACCCTTCAAGTGCCAGGTGGAATTTACATAATGAAA<br>TTATTTTTTAAAAATAGGTGTCCTTAGGGAGAGAAAACAGGAGCAAGCTCATGGTCT<br>GGCCTAGTCTCCCTCTCCCACTCCTTCTGATGACACTAGCAATGCATTCCATCTGAC<br>CTGACTTTATCATAGAGGCAAAATTGTTCAGAACACTGGCTGGAGATGGGGAGAAAT<br>AAGGAAACTTCTTGTGAACACCCTACACACACACACACACACACACACACACACACA<br>CACACACACACACACACACACACACACACATTTATTTACCTCCTCCTGAACCATGAA<br>TCGTATTGGTGATTTTGCTATATTGACAGATTCTCATCTGTTACACTCTAGGATCTC<br>TCACAGGTCTGTGGCAATTACTGTTCATGATTTCCTGAAAAAATATTTTTTTAAAAG<br>AAAACTATTTTTTTTAAATACTAGAGAGACAGTGGACTAGGAAAGCGAGAACTTGCC<br>GCCTTGTCTAGTGACTGTATTCAATGACTGAACAGAGGCCCCCCCCACCATACAAGA<br>GTTTTAGGTGATTGAGTGGGTGGAACCAGCTGGAGCCAGGTGGGAGGGGCCTTTACA<br>TTGCCAGCAGGGCCCCAAAGAATTGAGATTGTGTATGGCAACCGTTAATGAGGACAG<br>CGCCTGATGCCTTTTGTACCGAGGAAGATAATTGCCTCTTGTTTGACAAGTAGAGTT<br>TAGTAGGTTATTACAAAAAGGGCAAGAGTTGTTTTGGTTTTGTTTCTTTCAAAATAA<br>TTTTTTTTCAAAAGAATAACAAGGGTTAGGCAAATGGGGGACCTTCCTGTGTGCTCT<br>TGGGGGTCTGCTCAGCATCTGGAAATTTGGGTGTGCGATTTTCCCTGAACACATTGC<br>ATACCAGTGTAAAAAGACTCTGCCTCCCCCCTTTTTGGCTTTTTTACTGGGCTTGGC<br>TGGCCTTGCAGTTTACCAGATTCATTTACAGACTCTCTGCTCTGTATGGCGCCGCCT<br>GCCATGTCTGTCTTGGTGACTATCCTGCCTTAATCACTTTGCTTTAGGGCAACTCAT<br>GGTGATCTCTTCCAAGATCTGTTTTTAAATTGTTTGGACTACTTGAGCCACAACTCT<br>CAGAGGACATTCCTTTTTTTTTTTTTTTTTTTCTCCTTTCTTCCATTGCTTTGTC<br>CCTCTTCCCCTGTGCTTCCTGCCTTCTTTCCCTGTCCCATGGGCACAGTCCTCACAG<br>GGAGTGGCCTCCTCTCCAGTGATGTAAGTGAATGGAAGCCATCACTGGCTGCACA<br>TACCTTTTTCAAAAGGGACACTCGGGAAGTCACTGCTGTGACCGTTTCGATGTTGAT<br>AAGAAGGTGAATTTACTGTAGTGTTACCACCTTCTCCCCACTTGATGGTTCTTGACT<br>TTGTAAAAATTTAAATAAATGAATGTCTATACTTTTTAAGGAAAAGAGAAAATACCA<br>TGTCACAGAAAAGGTGAAACTATTAGATGCTGTTTAGAAAGCATTTATCTTGCATTT<br>CTTTATTCTTTCTAATTACCTAAAATTCAATAAAAGTTTATTCATATAAAAAAAAAA<br>AAAAAAAAAA (SEQ ID NO: 75)<br><br>>NP_733548.2 immunoglobulin superfamily member 11<br>precursor [Mus musculus]<br>MTRRRSAPASWLLVSLLGVATSLEVSESPGSVQVARGQTAVLPCAFSTSAALLNLNV<br>IWMVIPLSNANQPEQVILYQGGQMFDGALRFHGRVGFTGTMPATNVSIFINNTQLSD<br>TGTYQCLVNNLPDRGGRNIGVTGLTVLVPPSAPQCQIQGSQDLGSDVILLCSSEEGI<br>PRPTYLWEKLDNTLKLPPTATQDQVQGTVTIRNISALSSGLYQCVASNAIGTSTCLL<br>DLQVISPQPRSVGVIAGAVGTGAVLIVICLALISGAFFYWRSKNKEEEEEEIPNEIR<br>EDDLPPKCSSAKAFHTEISSSENNTLTSSNTYNSRYWNNNPKPHRNTESFNHFSDLR<br>QSFSGNAVIPSIYANGNHLVLGPHKTLVVTANRGSSPQVLPRNNGSVSRKPWPQHTH<br>SYTVSQMTLERIGAVPVMVPAQSRAGSLV (SEQ ID NO: 76) |
| Human VSIG4 | >NM_007268.3 Homo sapiens V-set and immunoglobulin domain containing 4 (VSIG4), transcript variant 1, mRNA<br>ACAGACGCTGGCGGCCACCAGAAGTTTGAGCCTCTTTGGTAGCAGGAGGCTGGAAGA<br>AAGGACAGAAGTAGCTCTGGCTGTGATGGGGATCTTACTGGGCCTGCTACTCCTGGG<br>GCACCTAACAGTGGACACTTATGGCCGTCCCATCCTGGAAGTGCCAGAGAGTGTAAC<br>AGGACCTTGGAAAGGGGATGTGAATCTTCCCTGCACCTATGACCCCCTGCAAGGCTA<br>CACCCAAGTCTTGGTGAAGTGGCTGGTACAACGTGGCTCAGACCCTGTCACCATCTT<br>TCTACGTGACTCTTCTGGAGACCATATCCAGCAGGCAAAGTACCAGGGCCGCCTGCA<br>TGTGAGCCACAAGGTTCCAGGAGATGTATCCCTCCAATTGAGCACCCTGGAGATGGA<br>TGACCGGAGCCACTACACGTGTGAAGTCACCTGGCAGACTCCTGATGGCAACCAAGT<br>CGTGAGAGATAAGATTACTGAGCTCCGTGTCCAGAAACTCTCTGTCTCCAAGCCCAC<br>AGTGACAACTGGCAGCGGTTATGGCTTCACGGTGCCCCAGGGAATGAGGATTAGCCT<br>TCAATGCCAGGCTCGGGGTTCTCCTCCCATCAGTTATATTTGGTATAAGCAACAGAC<br>TAATAACCAGGAACCCATCAAAGTAGCAACCCTAAGTACCTTACTCTTCAAGCCTGC<br>GGTGATAGCCGACTCAGGCTCCTATTTCTGCACTGCCAAGGGCCAGGTTGGCTCTGA<br>GCAGCACAGCGACATTGTGAAGTTTGTGGTCAAAGACTCCTCAAAGCTACTCAAGAC<br>CAAGACTGAGGCACCTACAACCATGACATACCCCTTGAAAGCAACATCTACAGTGAA<br>GCAGTCCTGGGACTGGACCACTGACATGGATGGCTACCTTGGAGAGACCAGTGCTGG<br>GCCAGGAAAGAGCCTGCCTGTCTTTGCCATCATCCTCATCATCTCCTTGTGCTGTAT<br>GGTGGTTTTTACCATGGCCTATATCATGCTCTGTCGGAAGACATCCCAACAAGAGCA<br>TGTCTACGAAGCAGCCAGGGCACATGCCAGAGAGGCCAACGACTCTGGAGAAACCAT<br>GAGGGTGGCCATCTTCGCAAGTGGCTGCTCCAGTGATGAGCCAACTTCCCAGAATCT<br>GGGCAACAACTACTCTGATGAGCCCTGCATAGGACAGGAGTACCAGATCATCGCCCA<br>GATCAATGGCAACTACGCCCGCCTGCTGGACACAGTTCCTCTGGATTATGAGTTTCT<br>GGCCACTGAGGGCAAAAGTGTCTGTTAAAAATGCCCCATTAGGCCAGGATCTGCTGA<br>CATAATTGCCTAGTCAGTCCTTGCCTTCTGCATGGCCTTCTTCCCTGCTACCTCTCT<br>TCCTGGATAGCCCAAAGTGTCCGCCTACCAACACTGGAGCCGCTGGGAGTCACTGGC<br>TTTGCCCTGGAATTTGCCAGATGCATCTCAAGTAAGCCAGCTGCTGGATTTGGCTCT<br>GGGCCCTTCTAGTATCTCTGCCGGGGGCTTCTGGTACTCCTCTAAATACCAGAGG<br>GAAGATGCCCATAGCACTAGGACTTGGTCATCATGCCTACAGACACTATTCAACTTT<br>GGCATCTTGCCACCAGAAGACCCGAGGGAGGCTCAGCTCTGCCAGCTCAGAGGACCA<br>GCTATATCCAGGATCATTTCTCTTTCTTCAGGGCCAGACAGCTTTTAATTGAAATTG<br>TTATTTCACAGGCCAGGGTCAGTTCTGCTCCTCCACTATAAGTCTAATGTTCTGAC<br>TCTCTCCTGGTGCTCAATAAATATCTAATCATAACAGCAA (SEQ ID NO: 77) |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | >NP_009199.1 V-set and immunoglobulin domain-containing protein 4 isoform 1 precursor [Homo sapiens]<br>MGILLGLLLLGHLTVDTYGRPILEVPESVTGPWKGDVNLPCTYDPLQGYTQVLVKWL<br>VQRGSDPVTIFLRDSSGDHIQQAKYQGRLHVSHKVPGDVSLQLSTLEMDDRSHYTCE<br>VTWQTPDGNQVVRDKITELRVQKLSVSKPTVTTGSGYGFTVPQGMRISLQCQARGSP<br>PISYIWYKQQTNNQEPIKVATLSTLLFKPAVIADSGSYFCTAKGQVGSEQHSDIVKF<br>VVKDSSKLLKTKTEAPTTMTYPLKATSTVKQSWDWTTDMDGYLGETSAGPGKSLPVF<br>AIILIISLCCMVVFTMAYIMLCRKTSQQEHVYEAARAHAREANDSGETMRVAIFASG<br>CSSDEPTSQNLGNNYSDEPCIGQEYQIIAQINGNYARLLDTVPLDYEFLATEGKSVC<br>(SEQ ID NO: 78) |
| Mouse VSIG4 | >NM_177789.5 Mus musculus V-set and immunoglobulin domain containing 4 (Vsig4), mRNA<br>AGCTACCAGCACTTCCAGGTTCTTCAGCAGCAAGAGGATGGAAGGATGAATAGAAGT<br>AGCTTCAAATAGGATGGAGATCTCATCAGGCTTGCTGTTCCTGGGCCACCTAATAGT<br>GCTCACCTATGGCCACCCCACCCTAAAAACACCTGAGAGTGTGACAGGGACCTGGAA<br>AGGAGATGTGAAGATTCAGTGCATCTATGATCCCCTGAGAGGCTACAGGCAAGTTTT<br>GGTGAAATGGCTGGTAAGACACGGCTCTGACTCCGTCACCATCTTCCTACGTGACTC<br>CACTGGGAGACCATATCCAGCAGGCAAAGTACAGAGGCCGCCTGAAAGTGAGCCACA<br>AGTTCCAGGAGATGTGTCCCTCCAAATAAATACCCTGCAGATGGATGACAGGAATCA<br>CTATACATGTGAGGTCACCTGGCAGACTCCTGATGGAAACCAAGTAATAAGAGATAA<br>GATCATTGAGCTCCGTGTTCGGAAATATAATCCACCTAGAATCAATACTGAAGCACC<br>TACAACCCTGCACTCCTCTTTGGAAGCAACAACTATAATGAGTTCAACCTCTGACTT<br>GACCACTAATGGGACTGGAAAACTTGAGGAGACCATTGCTGGTTCAGGGAGGAACCT<br>GCCAATCTTTGCCATAATCTTCATCATCTCCCTTTGCTGCATAGTAGCTGTCACCAT<br>ACCTTATATCTTGTTCCGCTGCAGGACATTCCAACAAGAGTATGTCTATGGAGTGAG<br>CAGGGTGTTTGCCAGGAAGACAAGCAACTCTGAAGAAACCACAAGGGTGACTACCAT<br>CGCAACTGATGAACCAGATTCCCAGGCTCTGATTAGTGACTACTCTGATGATCCTTG<br>CCTCAGCCAGGAGTACCAAATAACCATCGATCAACAATGTCTATTCCTGCCTGCTG<br>AACACAGTTTCCAGAAACTAAGAAGTTCTTGCTACTGAAGAAAATAACATCTGCTAA<br>AATGCCCCTACTAAGTCAAGGTCTACTGGCGTAATTACCTGTTACTTATTTACTACT<br>TGCCTTCAACATAGCTTTCTCCCTGGCTTCCTTTCTTCTTAGACAACCTAAAGTATC<br>TATCTAGTCTGCCAATTCTGGGGCCATTGAGAAATCCTGGGTTTGGCTAAGAATATA<br>CTACATGCACCTCAAGAAATCTAGCTTCTGGGCTTCACCCAGAACAATTTTCTTCCT<br>AGGGCCTTCACAACTCTTCTCCAAACAGCAGAGAAATTCCATAGCAGTAGAGGTTCT<br>TTATCATGCCTCCAGACAGCGTGAGTCTCAGTCCTACAAACTCAGACAAGCACATGG<br>GTCTAGGATTACTCCTCTTTCTCTAGGGCCAGATGACTTTTAATTGATATTACTATT<br>GCTACATTATGAATCTAATGCACATGTATTCTTTTGTTGTTAATAAATGTTTAATCA<br>TGACATCAA(SEQ ID NO: 79) |
| | >NP_808457.1 V-set and immunoglobulin domain-containing protein 4 precursor [Mus musculus]<br>MEISSGLLFLGHLIVLTYGHPTLKTPESVTGTWKGDVKIQCIYDPLRGYRQVLVKWL<br>VRHGSDSVTIFLRDSTGDHIQQAKYRGRLKVSHKVPGDVSLQINTLQMDDRNHYTCE<br>VTWQTPDGNQVIRDKIIELRVRKYNPPRINTEAPTTLHSSLEATTIMSSTSDLTTNG<br>TGKLEETIAGSGRNLPIFAIIFIISLCCIVAVTIPYILFRCRTFQQEYVYGVSRVFA<br>RKTSNSEETTRVTTIATDEPDSQALISDYSDDPCLSQEYQITIRSTMSIPAC (SEQ ID NO: 80) |
| Human Tim-3 (HAVCR2) | >NM_032782.5 Homo sapiens hepatitis A virus cellular receptor 2 (HAVCR2) , mRNA<br>ATTTGGAGAGTTAAAACTGTGCCTAACAGAGGTGTCCTCTGACTTTTCTTCTGCAAG<br>CTCCATGTTTTCACATCTTCCCTTTGACTGTGTCCTGCTGCTGCTGCTGCTACTACT<br>TACAAGGTCCTCAGAAGTGGAATACAGAGCGGAGGTCGGTCAGAATGCCTATCTGCC<br>CTGCTTCTACACCCCAGCCGCCCCAGGGAACCTCGTGCCCGTCTGCTGGGGCAAAGG<br>AGCCTGTCCTGTGTTTGAATGTGGCAACGTGGTGCTCAGGACTGATGAAAGGGATGT<br>GAATTATTGGACATCCAGATACTGGCTAAATGGGGATTTCCGCAAAGGAGATGTGTC<br>CCTGACCATAGAGAATGTGACTCTAGCAGACAGTGGGATCTACTGCTGCCGGATCCA<br>AATCCCAGGCATAATGAATGATGAAAAATTTAACCTGAAGTTGGTCATCAAACCAGC<br>CAAGGTCACCCCTGCACCGACTCGGCAGAGAGACTTCACTGCAGCCTTTCCAAGGAT<br>GCTTACCACCAGGGGACATGGCCCAGCAGAGACACAGACACTGGGGAGCCTCCCTGA<br>TATAAATCTAACACAAATATCCACATTGGCCAATGAGTTACGGGACTCTAGATTGGC<br>CAATGACTTACGGGACTCTGGAGCAACCATCAGAATAGGCATCTACATCGGAGCAGG<br>GATCTGTGCTGGGCTGGCTCTGGCTCTTATCTTCGGCGCTTTAATTTTCAAATGGTA<br>TTCTCATAGCAAAGAGAAGATACAGAATTTAAGCCTCATCTCTTTGGCCAACCTCCC<br>TCCCTCAGGATTGGCAAATGCAGTAGCAGAGGGAATTCGCTCAGAAGAAAACATCTA<br>TACCATTGAAGAGAACGTATATGAAGTGGAGGAGCCCAATGAGTATTATTGCTATGT<br>CAGCAGCAGGCAGCAACCCTCACAACCTTTGGGTTGTCGCTTTGCAATGCCATAGAT<br>CCAACCACCTTATTTTTGAGCTTGGTGTTTTGTCTTTTTCAGAAACTATGAGCTGTG<br>TCACCTGACTGGTTTTGGAGGTTCTGTCCACTGCTATGGAGCAGAGTTTTCCCATTT<br>TCAGAAGATAATGACTCACATGGGAATTGAACTGGGACCTGCACTGAACTTAAACAG<br>GCATGTCATTGCCTCTGTATTTAAGCCAACAGAGTTACCCAACCCAGAGACTGTTAA<br>TCATGGATGTTAGAGCTCAAACGGGCTTTTATATACACTAGGAATTCTTGACGTGGG<br>GTCTCTGGAGCTCCAGGAAATTCGGGCACATCATATGTCCATGAAACTTCAGATAAA |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | CTAGGGAAAACTGGGTGCTGAGGTGAAAGCATAACTTTTTTGGCACAGAAAGTCTAA<br>AGGGGCCACTGATTTTCAAAGAGATCTGTGATCCCTTTTTGTTTTTTGTTTTTGAGA<br>TGGAGTCTTGCTCTGTTGCCCAGGCTGGAGTGCAATGGCACAATCTCGGCTCACTGC<br>AAGCTCCGCCTCCTGGGTTCAAGCGATTCTCCTGCCTCAGCCTCCTGAGTGGCTGGG<br>ATTACAGGCATGCACCACCATGCCCAGCTAATTTGTTGTATTTTTAGTAGAGACAGG<br>GTTTCACCATGTTGGCCAGTGTGGTCTCAAACTCCTGACCTCATGATTTGCCTGCCT<br>CGGCCTCCCAAAGCACTGGGATTACAGGCGTGAGCCACCACATCCAGCCAGTGATCC<br>TTAAAAGATTAAGAGATGACTGGACCAGGTCTACCTTGATCTTGAAGATTCCCTTGG<br>AATGTTGAGATTTAGGCTTATTTGAGCACTGCCTGCCCAACTGTCAGTGCCAGTGCA<br>TAGCCCTTCTTTTGTCTCCCTTATGAAGACTGCCCTGCAGGGCTGAGATGTGGCAGG<br>AGCTCCCAGGGAAAAACGAAGTGCATTTGATTGGTGTGTATTGGCCAAGTTTTGCTT<br>GTTGTGTGCTTGAAAGAAAATATCTCTGACCAACTTCTGTATTCGTGGACCAAACTG<br>AAGCTATATTTTTCACAGAAGAAGAAGCAGTGACGGGGACACAAATTCTGTTGCCTG<br>GTGGAAAGAAGGCAAAGGCCTTCAGCAATCTATATTACCAGCGCTGGATCCTTTGAC<br>AGAGAGTGGTCCCTAAACTTAAATTTCAAGACGGTATAGGCTTGATCTGTCTTGCTT<br>ATTGTTGCCCCCTGCGCCTAGCACAATTCTGACACACAATTGGAACTTACTAAAAAT<br>TTTTTTTTACTGTT (SEQ ID NO: 81)<br><br>>NP_116171.3 hepatitis A virus cellular receptor 2 precursor [Homo sapiens]<br>MFSHLPFDCVLLLLLLLLLTRSSEVEYRAEVGQNAYLPCFYTPAAPGNLVPVCWGKGA<br>CPVFECGNVVLRTDERDVNYWTSRYWLNGDFRKGDVSLTIENVTLADSGIYCCRIQI<br>PGIMNDEKFNLKLVIKPAKVTPAPTRQRDFTAAFPRMLTTRGHGPAETQTLGSLPDI<br>NLTQISTLANELRDSRLANDLRDSGATIRIGIYIGAGICAGLALALIFGALIFKWYS<br>HSKEKIQNLSLISLANLPPSGLANAVAEGIRSEENIYTIEENVYEVEEPNEYYCYVS<br>SRQQPSQPLGCRFAMP (SEQ ID NO: 82) |
| Mouse Tim-3 (HAVCR2) | >NM_134250.2 Mus musculus hepatitis A virus cellular receptor 2 (Havcr2), mRNA<br>ACCATTTTAACCGAGGAGCTAAAGCTATCCCTACACAGAGCTGTCCTTGGATTTCCC<br>CTGCCAAGTACTCATGTTTTCAGGTCTTACCCTCAACTGTGTCCTGCTGCTGCTGCA<br>ACTACTACTTGCAAGGTCATTGGAAAATGCTTATGTGTTTGAGGTTGGTAAGAATGC<br>CTATCTGCCCTGCAGTTACACTCTATCTACACCTGGGGCACTTGTGCCTATGTGCTG<br>GGGCAAGGGATTCTGTCCTTGGTCACAGTGTACCAACGAGTTGCTCAGAACTGATGA<br>AAGAAATGTGACATATCAGAAATCCAGCAGATACCAGCTAAAGGGCGATCTCAACAA<br>AGGAGACGTGTCTCTGATCATAAAGAATGTGACTCTGGATGACCATGGGACCTACTG<br>CTGCAGGATACAGTTCCCTGGTCTTATGAATGATAAAAAATTAGAACTGAAATTAGA<br>CATCAAAGCAGCCAAGGTCACTCCAGCTCAGACTGCCCATGGGACTCTACTACAGC<br>TTCTCCAAGAACCCTAACCACGGAGAGAAATGGTTCAGAGACACAGACACTGGTGAC<br>CCTCCATAATAACAATGGAACAAAAATTTCCACATGGGCTGATGAAATTAAGGACTC<br>TGGAGAAACGATCAGAACTGCTATCCACATTGGAGTGGGAGTCTCTGCTGGGTTGAC<br>CCTGGCACTTATCATTGGTGTCTTAATCCTTAAATGGTATTCCTGTAAGAAAAAGAA<br>GTTATCGAGTTTGAGCCTTATTACACTGGCCAACTTGCCTCCAGGAGGGTTGGCAAA<br>TGCAGGAGCAGTCAGGATTCGCTCTGAGGAAAATATCTACACCATCGAGGAGAACGT<br>ATATGAAGTGGAGAATTCAAATGAGTACTACTGCTACGTCAACAGCCAGCAGCCATC<br>CTGACCGCCTCTGGACTGCCACTTTTAAAGGCTCGCCTTCATTTCTGACTTTGGTAT<br>TTCCCTTTTTGAAAACTATGTGATATGTCACTTGGCAACCTCATTGGAGGTTCTGAC<br>CACAGCCACTGAGAAAAGAGTTCCAGTTTTCTGGGGATAATTAACTCACAAGGGGAT<br>TCGACTGTAACTCATGCTACATTGAAATGCTCCATTTTATCCCTGAGTTTCAGGGAT<br>CGGATCTCCCACTCCAGAGACTTCAATCATGCGTGTTGAAGCTCACTCGTGCTTTCA<br>TACATTAGGAATGGTTAGTGTGATGTCTTTGAGACATAGAGGTTTGTGGTATATCTG<br>CAAAGCTCCTGAACAGGTAGGGGGAATAAAGGGCTAAGATAGGAAGGTGAGGTTCTT<br>TGTTGATGTTGAAAATCTAAAGAAGTTGGTAGCTTTTCTAGAGATTTCTGACCTTGA<br>AAGATTAAGAAAAAGCCAGGTGGCATATGCTTAACACTATATAACTTGGGAACCTTA<br>GGCAGGAGGGTGATAAGTTCAAGGTCAGCCAGGGCTATGCTGGTAAGACTGTCTCAA<br>AATCCAAAGACGAAAATAAACATAGAGACAGCAGGAGGCTGGAGATGAGGCTCGGAC<br>AGTGAGGTGCATTTTGTACAAGCACGAGGAATCTATATTTGATCGTAGACCCCACAT<br>GAAAAAGCTAGGCCTGGTAGAGACATGCTTGTAGACTCAAGAGATGGAGAGGTAAAGG<br>CACAACAGATCCCCGGGGCTTGCGTGCAGTCAGCTTAGCCTAGGTGCTGAGTTCCAA<br>GTCCACAAGAGTCCCTGTCTCAAAGTAAGATGGACTGAGTATCTGGCGAATGTCCAT<br>GGGGGTTGTCCTCTGCTCTCAGAAGAGACATGCACATGAACCTGCACACACACACAC<br>ACACACACACACACACACACACACACACACACACACACACATGAAATGAAGGTTC<br>TCTCTGTGCCTGCTACCTCTCTATAACATGTATCTCTACAGGACTCTCCTCTGCCTC<br>TGTTAAGACATGAGTGGGAGCATGGCAGAGCAGTCCAGTAATTAATTCCAGCACTCA<br>GAAGGCTGGAGCAGAAGCGTGGAGAGTTCAGGAGCACTGTGCCCAACACTGCCAGAC<br>TCTTCTTACAGAAGAAAAAGGTTACCCGCAAGCAGCCTGCTGTCTGTAAAAGGAAAC<br>CCTGCGAAAGGCAAACTTTGACTGTTGTGTGCTCAAGGGGAACTGACTCAGACAACT<br>TCTCCATTCCTGGAGGAAACTGGAGCTGTTTCTGACAGAAGAACAACCGGTGACTGG<br>GACATACGAAGGCAGAGCTCTTGCAGCAATCTATATAGTCAGCAAAATATTCTTTGG<br>GAGGACAGTCGTCACCAAATTGATTTCCAAGCCGGTGGACCTCAGTTTCATCTGGCT<br>TACAGCTGCCTGCCCAGTGCCCTTGATCTGTGCTGGCTCCCATCTATAACAGAATCA<br>AATTAAATAGACCCCGAGTGAAATATTAAGTGAGCAGAAAGGTAGCTTTGTTCAAA<br>GATTTTTTTGCATTGGGGAGCAACTGTGTACATCAGAGGACATCTGTTAGTGAGGAC<br>ACCAAAACCTGTGGTACCGTTTTTCATGTATGAATTTTGTTGTTAGGTTGCTTCT<br>AGCTAGCTGTGGAGGTCCTGGCTTTCTTAGGTGGGTATGGAAGGGAGACCATCTAAC |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | AAAATCCATTAGAGATAACAGCTCTCATGCAGAAGGGAAAACTAATCTCAAATGTTT<br>TAAAGTAATAAAACTGTACTGGCAAAGTACTTTGAGCATATTTAAA (SEQ ID<br>NO: 83)<br><br>>NP_599011.2 hepatitis A virus cellular receptor 2<br>homolog precursor [*Mus musculus*]<br>MFSGLTLNCVLLLLQLLLARSLENAYVFEVGKNAYLPCSYTLSTPGALVPMCWGKGF<br>CPWSQCTNELLRTDERNVTYQKSSRYQLKGDLNKGDVSLIIKNVTLDDHGTYCCRIQ<br>FPGLMNDKKLELKLDIKAAKVTPAQTAHGDSTTASPRTLTTERNGSETQTLVTLHNN<br>NGTKISTWADEIKDSGETIRTAIHIGVGVSAGLTLALIIGVLILKWYSCKKKKLSSL<br>SLITLANLPPGGLANAGAVRIRSEENIYTIEENVYEVENSNEYYCYVNSQQPS<br>(SEQ ID NO: 84) |
| Human Tim-4 (TIMD4) | >NM_138379.3 *Homo sapiens* T cell immunoglobulin and mucin<br>domain containing 4 (TIMD4), transcript variant 1, mRNA<br>AGACTCCTGGGTCCGGTCAACCGTCAAAATGTCCAAAGAACCTCTCATTCTCTGGCT<br>GATGATTGAGTTTTGGTGGCTTTACCTGACACCAGTCACTTCAGAGACTGTTGTGAC<br>GGAGGTTTTGGGTCACCGGGTGACTTTGCCCTGTCTGTACTCATCCTGGTCTCACAA<br>CAGCAACAGCATGTGCTGGGGAAAGACCAGTGCCCCTACTCCGGTTGCAAGGAGGC<br>GCTCATCCGCACTGATGGAATGAGGGTGACCTCAAGAAAGTCAGCAAAATATAGACT<br>TCAGGGGACTATCCCGAGAGGTGATGTCTCCTTGACCATCTTAAACCCCAGTGAAAG<br>TGACAGCGGTGTGTACTGCTGCCGCATAGAAGTGCCTGGCTGGTTCAACGATGTAAA<br>GATAAACGTGCGCCTGAATCTACAGAGAGCCTCAACAACCACGCACAGAACAGCAAC<br>CACCACCACACGCAGAACAACAACAACAAGCCCCACCACCACCCGACAAATGACAAC<br>AACCCCAGCTGCACTTCCAACAACAGTCGTGACCACACCCGATCTCACAACCGGAAC<br>ACCACTCCAGATGACAACCATTGCCGTCTTCACAACAGCAAACACGTGCCTTTCACT<br>AACCCCAAGCACCCTTCCGGAGGAAGCCACAGGTCTTCTGACTCCCGAGCCTTCTAA<br>GGAAGGGCCCATCCTCACTGCAGAATCAGAAACTGTCCTCCCCAGTGATTCCTGGAG<br>TAGTGTTGAGTCTACTTCTGCTGACACTGTCCTGCTGACATCCAAAGAGTCCAAAGT<br>TTGGGATCTCCCATCAACATCCCACGTGTCAATGTGGAAAACGAGTGATTCTGTGTC<br>TTCTCCTCAGCCTGGAGCATCTGATACAGCAGTTCCTGAGCAGAACAAAACAACAAA<br>AACAGGACAGATGGATGGAATACCCATGTCAATGAAGAATGAAATGCCCATCTCCCA<br>ACTACTGATGATCATCGCCCCCTCCTTGGGATTTGTGCTCTTCGCATTGTTTGTGGC<br>GTTTCTCCTGAGAGGGAAACTCATGGAAACCTATTGTTCGCAGAAACACACAAGGCT<br>AGACTACATTGGAGATAGTAAAAATGTCCTCAATGACGTGCAGCATGGAAGGGAAGA<br>CGAAGACGGCCTTTTTACCCTCTAACAACGCAGTAGCATGTTAGATTGAGGATGGGG<br>GCATGACACTCCAGTGTCAAAATAAGTCTTAGTAGATTTCCTTGTTTCATAAAAAAG<br>ACTCACTTATTCCATGGATGTCATTGATCCAGGCTTGCTTTAGTTTCATGAATGAAG<br>GGTACTTTAGAGACCACAA (SEQ ID NO: 85)<br><br>>NP_612388.2 T-cell immunoglobulin and mucin domain-<br>containing protein 4 isoform 1 precursor [*Homo sapiens*]<br>MSKEPLILWLMIEFWWLYLTPVTSETVVTEVLGHRVTLPCLYSSWSHNSNSMCWGKD<br>QCPYSGCKEALIRTDGMRVTSRKSAKYRLQGTIPRGDVSLTILNPSESDSGVYCCRI<br>EVPGWFNDVKINVRLNLQRASTTTHRTATTTTRRTTTTSPTTTRQMTTTPAALPTTV<br>VTTPDLTTGTPLQMTTIAVFTTANTCLSLTPSTLPEEATGLLTPEPSKEGPILTAES<br>ETVLPSDSWSSVESTSADTVLLTSKESKVWDLPSTSHVSMWKTSDSVSSPQPGASDT<br>AVPEQNKTTKTGQMDGIPMSMKNEMPISQLLMIIAPSLGFVLFALFVAFLLRGKLME<br>TYCSQKHTRLDYIGDSKNVLNDVQHGREDEDGLFTL (SEQ ID NO: 86) |
| Mouse Tim-4 (TIMD4) | >NM_178759.4 *Mus musculus* T cell immunoglobulin and mucin<br>domain containing 4 (Timd4), mRNA<br>AGATCCTATCAAAATGTCCAAGGGGCTTCTCCTCCTCTGGCTGGTGACGGAGCTCTG<br>GTGGCTTTATCTGACACCAGCTGCCTCAGAGGATACAATAATAGGGTTTTTGGGCCA<br>GCCGGTGACTTTGCCTTGTCATTACCTCTCGTGGTCCCAGAGCCGCAACAGTATGTG<br>CTGGGGCAAAGGTTCATGTCCCAATTCCAAGTGCAATGCAGAGCTTCTCCGTACAGA<br>TGGAACAAGAATCATCTCCAGGAAGTCAACAAAATATACACTTTTGGGGAAGGTCCA<br>GTTTGGTGAAGTGTCCTTGACCATCTCAAACACCAATCGAGGTGACAGTGGGGTGTA<br>CTGCTGCCGTATAGAGGTGCCTGGCTGGTTCAATGATGTCAAGAAGAATGTGCGCTT<br>GGAGCTGAGGAGAGCCACAACAACCAAAAAACCAACAACAACCACCCGGCCAACCAC<br>CACCCCTTATGTGACCACCACCACCCCAGAGCTGCTTCCAACAACAGTCATGACCAC<br>ATCTGTTCTCCCAACCACCACCACCCCCAGACACTAGCCACCACTGCCTTCAGTAC<br>AGCAGTGACCACGTGCCCCTCAACAACACCTGGCTCCTTCTCACAAGAAACCACAAA<br>AGGGTCCGCCTTCACTACAGAATCAGAAACTCTGCCTGCATCCAATCACTCTCAAAG<br>AAGCATGATGACCATATCTACAGACATAGCCGTACTCAGGCCCACAGGCTCTAACCC<br>TGGGATTCTCCCATCCACTTCACAGCTGACGACACAGAAAACAACATTAACAACAAG<br>TGAGTCTTTGCAGAAGACAACTAAATCACATCAGATCAACAGCAGACAGACCATCTT<br>GATCATTGCCTGCTGTGTGGGATTTGTGCTAATGGTGTTATTGTTTCTGGCGTTTCT<br>CCTTCGAGGGAAAGTCACAGGAGCCAACTGTTTGCAGAGACACAAGAGGCCAGACAA<br>CACTGAAGATAGTGACAGCGTCCTCAATGACATGTCACACGGGAGGGATGATGAAGA<br>CGGGATCTTCACTCTCTGACTCACCATCTTTATTTAGGATTAAGGATAGGGAATGGC<br>ACTTGAATTGTCAAAATAAGTTTGGGGACATTGTAATTTCCGTTTAAAGTCTCACTC<br>TGTTTACTGATGCTGTGGGTCCTGTCTGGTTGTATCTTCCCACATGAAGGTGCTTTA<br>GAGACACATTTTCCCTGCCTCGTGCCTTAGTCCTCTTTGTTGTTTTGTGGCTAGGTG<br>ACTTTTCACACTGGGCTTGAACACTGTCAGTGATGGTGAAATCCTTGCCACAGCTTT |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | GGGAGTCTCTTGCAGTCTCCCAGCAGTAGAGGGAGTTAGAAATATCCAGAGGGGAAA<br>AAAAAATCTCTCTTTTCAGACAGTATCTGCTTTATTGGTGGTAGCTGAACTTCATTT<br>ATACAGAGCTCCTTTAACCTGTCTGTCTTCTTCTTGGTATCTAAGCTGCCTTTTGTT<br>TTTGTTTTTGTTTTTGTTTTTATGATATTAACTTCTTTTCACATTCAAGTTTCTTTA<br>AAGTTGACTATAGTGCCTTCTGAACTCTTGCAGAGAGTTTGGATTTTGGAAGCTGCC<br>AGGTACCCATCACAGCAGGGGTGCCAGTGACAAGGATGGTGTACAAATGAAACACTG<br>AAGCTATCCAAATAAATTCCTCTAAGTGTAATTCATTTTACTGCAGCACAGGAAGAA<br>CAAATTTGTCTTACAACTTTAATAATTAGTACCATTATGAACCCTAGGAGAGAAATA<br>AGAGCAAATACCTGTTGAATAAATGAATGTAAGAAAATGTGTGTCTGAGCAAGAATA<br>CTCTGTCTGGCTACTATGGGAAGCTAGCTAGATCTGAAAGACATTCTCAGACTATCC<br>TCATGTTCAAGGCATTAAAGGAATAAGCCTCCAGCCCCTAACCTTAGGAGAATTCTG<br>CAGTCAAGTGAGGAGTTTTTAAAACAGGAATCTCTAGGTTCCAGTCCTCTAGCTATT<br>CTTTTATGCTTAGTCCAGGTAATGAGTTGAACATCCAAGTATTTTTTAAGGACCCAA<br>AGAAATGCAACCAGAGCTATTACCAGAATTTTGGAGTGGTCCTCCTAGAGTTGCCGC<br>ATGTTGCTGGGAAAATTGGGGTCTTAGAGTTCTTAGTCTACTTAATAAAAGAATTTT<br>AAAAAATGG (SEQ ID NO: 87)<br><br>>NP_848874.3 T-cell immunoglobulin and mucin domain-<br>containing protein 4 precursor [Mus musculus]<br>MSKGLLLLWLVTELWWLYLTPAASEDTIIGFLGQPVTLPCHYLSWSQSRNSMC<br>WGKGSCPNSKCNAELLRTDGTRIISRKSTKYTLLGKVQFGEVSLTISNTNRGD<br>SGVYCCRIEVPGWFNDVKKNVRLELRRATTTKKPTTTTRPTTTPYVTTTTPEL<br>LPTTVMTTSVLPTTTPPQTLATTAFSTAVTTCPSTTPGSFSQETTKGSAFTTE<br>SETLPASNHSQRSMMTISTDIAVLRPTGSNPGILPSTSQLTTQKTTLTTSESL<br>QKTTKSHQINSRQTILIIACCVGFVLMVLLFLAFLLRGKVTGANCLQRHKRPD<br>NTEDSDSVLNDMSHGRDDEDGIFTL (SEQ ID NO: 88) |
| Human CEACAM1 | >NM_001712.5 Homo sapiens CEA cell adhesion molecule<br>1 (CEACAM1), transcript variant 1, mRNA<br>AGCACAGAGAGTGGAAAACAGCAGAGGTGACAGAGCAGCCGTGCTCGAAGCGT<br>TCCTGGAGCCCAAGCTCTCCTCCACAGGTGAAGACAGGGCCAGCAGGAGACAC<br>CATGGGGCACCTCTCAGCCCCACTTCACAGAGTGCGTGTACCCTGGCAGGGGC<br>TTCTGCTCACAGCCTCACTTCTAACCTTCTGGAACCCGCCCACCACTGCCCAG<br>CTCACTACTGAATCCATGCCATTCAATGTTGCAGAGGGGAAGGAGGTTCTTCT<br>CCTTGTCCACAATCTGCCCCAGCAACTTTTTGGCTACAGCTGGTACAAAGGGG<br>AAAGAGTGGATGGCAACCGTCAAATTGTAGGATATGCAATAGGAACTCAACAA<br>GCTACCCCAGGGCCCGCAAACAGCGGTCGAGAGACAATATACCCAATGCATC<br>CCTGCTGATCCAGAACGTCACCCAGAATGACACAGGATTCTACACCCTACAAG<br>TCATAAAGTCAGATCTTGTGAATGAAGAAGCAACTGGACAGTTCCATGTATAC<br>CCGGAGCTGCCCAAGCCCTCCATCTCCAGCAACAACTCCAACCCTGTGGAGGA<br>CAAGGATGCTGTGGCCTTCACCTGTGAACCTGAGACTCAGGACACAACCTACC<br>TGTGGTGGATAAACAATCAGAGCCTCCCGGTCAGTCCCAGGCTGCAGCTGTCC<br>AATGGCAACAGGACCCTCACTCTACTCAGTGTCACAAGGAATGACACAGGACC<br>CTATGAGTGTGAAATACAGAACCCAGTGAGTGCGAACCGCAGTGACCCAGTCA<br>CCTTGAATGTCACCTATGGCCGGACACCCCCACCATTTCCCCTTCAGACACC<br>TATTACCGTCCAGGGGCAAACCTCAGCCTCTCCTGCTATGCAGCCTCTAACCC<br>ACCTGCACAGTACTCCTGGCTTATCAATGGAACATTCCAGCAAAGCACACAAG<br>AGCTCTTTATCCCTAACATCACTGTGAATAATAGTGGATCCTATACCTGCCAC<br>GCCAATAACTCAGTCACTGGCTGCAACAGGACCACAGTCAAGACGATCATAGT<br>CACTGAGCTAAGTCCAGTAGTAGCAAAGCCCCAAATCAAAGCCAGCAAGACCA<br>CAGTCACAGGAGATAAGGACTCTGTGAACCTGACCTGCTCCACAAATGACACT<br>GGAATCTCCATCCGTTGGTTCTTCAAAAACCAGAGTCTCCCGTCCTCGGAGAG<br>GATGAAGCTGTCCCAGGGCAACACCACCCTCAGCATAAACCCTGTCAAGAGGG<br>AGGATGCTGGGACGTATTGGTGTGAGGTCTTCAACCCAATCAGTAAGAACCAA<br>AGCGACCCCATCATGCTGAACGTAAACTATAATGCTCTACCACAAGAAAATGG<br>CCTCTCACCTGGGGCCATTGCTGGCATTGTGATTGGAGTAGTGGCCCTGGTTG<br>CTCTGATAGCAGTAGCCCTGGCATGTTTTCTGCATTTCGGGAAGACCGGCAGG<br>GCAAGCGACCAGCGTGATCTCACAGAGCACAAACCCTCAGTCTCCAACCACAC<br>TCAGGACCACTCCAATGACCCACCTAACAAGATGAATGAAGTTACTTATTCTA<br>CCCTGAACTTTGAAGCCCAGCAACCCACACAACCAACTTCAGCCTCCCCATCC<br>CTAACAGCCACAGAAATAATTTATTCAGAAGTAAAAAAGCAGTAATGAAACCT<br>GTCCTGCTCACTGCAGTGCTGATGTATTTCAAGTCTCTCACCCTCATCACTAG<br>GAGATTCCTTTCCCCTGTAGGGGTAGAGGGGTGGGGACAGAAACAACTTTCTC<br>CTACTCTTCCTTCCTAATAGGCATCTCCAGGCTGCCTGGTCACTGCCCCTCTC<br>TCAGTGTCAATAGATGAAATACATTGGGAGTCTGTAGGAAACCCAACCTTCT<br>TGTCATTGAAATTTGGCAAAGCTGACTTTGGGAAAGAGGGACCAGAACTTCCC<br>CTCCCTTCCCCTTTTCCCAACCTGGACTTGTTTTAAACTTGCCTGTTCAGAGC<br>ACTCATTCCTTCCCACCCCCAGTCCTGTCCTATCACTCTAATTCGGATTTGCC<br>ATAGCCTTGAGGTTATGTCCTTTTCCATTAAGTACATGTGCCAGGAAACAAGA<br>GAGAGAGAAAGTAAAGGCAGTAATGCCTTCTCCTATTTCTCCAAAGCCTTGTG<br>TGAACTCACCAAACACAAGAAAATCAAATATATAACCAATAGTGAAATGCCAC<br>ACCTTTGTCCACTGTCAGGGTTGTCTACCTGTAGGATCAGGGTCTAAGCACCT<br>TGGTGCTTAGCTAGAATACCACCTAATCCTTCTGGCAAGCCTGTCTTCAGAGA<br>ACCCACTAGAAGCAACTAGGAAATACACTTGCCAAAATCAAGGCAATTCCTG<br>ATGGAAAATGCAAAAGCACATATATGTTTTAATATCTTTATGGGCTCTGTTCA |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | AGGCAGTGCTGAGAGGGAGGGGTTATAGCTTCAGGAGGGAACCAGCTTCTGAT<br>AAACACAATCTGCTAGGAACTTGGGAAAGGAATCAGAGAGCTGCCCTTCAGCG<br>ATTATTTAAATTATTGTTAAAGAATACACAATTTGGGGTATTGGGATTTTTCT<br>CCTTTTCTCTGAGACATTCCACCATTTTAATTTTTGTAACTGCTTATTTATGT<br>GAAAAGGGTTATTTTTACTTAGCTTAGCTATGTCAGCCAATCCGATTGCCTTA<br>GGTGAAAGAAACCACCGAAATCCCTCAGGTCCCTTGGTCAGGAGCCTCTCAAG<br>ATTTTTTTTGTCAGAGGGCTCCAAATAGAAAATAAGAAAAGGTTTTCTTCATTC<br>ATGGCTAGAGCTAGATTTAACTCAGTTTCTAGGCACCTCAGACCAATCATCAA<br>CTACCATTCTATTCCATGTTTGCACCTGTGCATTTTCTGTTTGCCCCCATTCA<br>CTTTGTCAGGAAACCTTGGCCTCTGCTAAGGTGTATTTGGTCCTTGAGAAGTG<br>GGAGCACCCTACAGGGACACTATCACTCATGCTGGTGGCATTGTTTACAGCTA<br>GAAAGCTGCACTGGTGCTAATGCCCCTTGGGGAAATGGGGCTGTGAGGAGGAG<br>GATTATAACTTAGGCCTAGCCTCTTTTAACAGCCTCTGAAATTTATCTTTTCT<br>TCTATGGGGTCTATAAATGTATCTTATAATAAAAAGGAAGGACAGGAGGAAGA<br>CAGGCAAATGTACTTCTCACCCAGTCTTCTACACAGATGGAATCTCTTTGGGG<br>CTAAGAGAAAGGTTTTATTCTATATTGCTTACCTGATCTCATGTTAGGCCTAA<br>GAGGGCTTTCTCCAGGAGGATTAGCTTGGAGTTCTCTATACTCAGGTACCTCTT<br>TCAGGGTTTTCTAACCCTGACACGGACTGTGCATACTTTCCCTCATCCATGCT<br>GTGCTGTGTTATTTAATTTTTCCTGGCTAAGATCATGTCTGAATTATGTATGA<br>AAATTATTCTATGTTTTTATAATAAAAATAATATATCAGACATCGA (SEQ<br>ID NO: 89)<br><br>>NP_001703.2 carcinoembryonic antigen-related cell<br>adhesion molecule 1 isoform 1 precursor [Homo<br>sapiens]<br>MGHLSAPLHRVRVPWQGLLLTASLLTFWNPPTTAQLTTESMPFNVAEGKEVLL<br>LVHNLPQQLFGYSWYKGERVDGNRQIVGYAIGTQQATPGPANSGRETIYPNAS<br>LLIQNVTQNDTGFYTLQVIKSDLVNEEATGQFHVYPELPKPSISSNNSNPVED<br>KDAVAFTCEPETQDTTYLWWINNQSLPVSPRLQLSNGNRTLTLLSVTRNDTGP<br>YECEIQNPVSANRSDPVTLNVTYGPDTPTISPSDTYYRPGANLSLSCYAASNP<br>PAQYSWLINGTFQQSTQELFIPNITVNNSGSYTCHANNSVTGCNRTTVKTIIV<br>TELSPVVAKPQIKASKTTVTGDKDSVNLTCSTNDTGISIRWFFKNQSLPSSER<br>MKLSQGNTTLSINPVKREDAGTYWCEVFNPISKNQSDPIMLNVNYNALPQENG<br>LSPGAIAGIVIGVVALVALIAVALACFLHFGKTGRASDQRDLTEHKPSVSNHT<br>QDHSNDPPNKMNEVTYSTLNFEAQQPTQPTSASPSLTATEIIYSEVKKQ<br>(SEQ ID NO: 90) |
| Mouse CEACAM1 | >NM_001039185.1 Mus musculus carcinoembryonic<br>antigen-related cell adhesion molecule 1 (Ceacam1),<br>transcript variant 1, mRNA<br>AAAGCTCCTTTAAGAAAAGCAGGGCAGATATCAGGGCAGCCTGGCTTAGCAGT<br>AGTGTTGGAGAAGAAGCTAGCAGGCAGGCAGCAGAGACATGGAGCTGGCCTCA<br>GCACATCTCCACAAAGGGCAGGTTCCCTGGGGAGGACTACTGCTCACAGCCTC<br>ACTTTTAGCCTCCTGGAGCCCTGCCACCACTGCTGAAGTCACCATTGAGGCTG<br>TGCCGCCCCAGGTTGCTGAAGACAACAATGTTCTTCTACTTGTTCACAATCTG<br>CCCCTGGCGCTTGGAGCCTTTGCCTGGTACAAGGGAAACACTACGGCTATAGA<br>CAAAGAAATTGCACGATTTGTACCAAATAGTAATATGAATTTCACGGGGCAAG<br>CATACAGCGGCAGAGAGATAATATACAGCAATGGATCCCTGCTCTTCCAAATG<br>ATCACCATGAAGGATATGGGAGTCTACACACTAGATATGACAGATGAAAACTA<br>TCGTCGTACTCAGGCGACTGTGCGATTTCATGTACACCCCATATTATTAAAGC<br>CCAACATCACAAGCAACAACTCCAATCCCGTGGAGGGTGACGACTCCGTATCA<br>TTAACCTGTGACTCTTACACTGACCCTGATAATATAAACTACCTGTGGAGCAG<br>AAATGGTGAAAGCCTTTCAGAAGGTGACAGGCTGAAGCTGTCTGAGGGCAACA<br>GGACTCTCACTTTACTCAATGTCACGAGGAATGACACAGGACCCTATGTGTGT<br>GAAACCCGGAATCCAGTGAGTGTCAACCGAAGTGACCCATTCAGCCTGAACAT<br>TATCTATGGTCCGGACACCCCGATTATATCCCCCTCAGATATTTATTTGCATC<br>CAGGGTCAAACCTCAACCTCTCCTGCCATGCAGCCTCTAACCCACCTGCACAG<br>TACTTTTGGCTTATCAATGAGAAGCCCCATGCATCCTCCCAAGAGCTCTTTAT<br>CCCCAACATCACTACTAATAATAGCGGAACCTATACCTGCTTCGTCAATAACT<br>CTGTCACTGGCCTCAGTAGGACCACAGTCAAGAACATTACAGTCCTTGAGCCA<br>GTGACTCAGCCCTTCCTCCAAGTCACCAACACCACAGTCAAAGAACTAGACTC<br>TGTGACCCTGACCTGCTTGTCGAATGACATTGGAGCCAACATCCAGTGGCTCT<br>TCAATAGCCAGAGTCTTCAGCTCACAGAGAGAATGACACTCTCCCAGAACAAC<br>AGCATCCTCAGAATAGACCCTATTAAGAGGGAAGATGCCGGCGAGTATCAGTG<br>TGAAATCTCGAATCCAGTCAGCGTCAGGAGGAGCAACTCAATCAAGCTGGACA<br>TAATATTTGACCCAACACAAGGAGGCCTCTCAGATGGCGCCATTGCTGGCATC<br>GTGATTGGAGTTGTGGCTGGGGTGGCTCTAATAGCAGGGCTGGCATATTTCCT<br>CTATTCCAGGAAGTCTGGCGGGGAAGTGACCAGCGAGATCTCACAGAGCACA<br>AACCCTCAGCCTCCAACCACAATCTGGCTCCTTCTGACAACTCTCCTAACAAG<br>GTGGATGACGTCGCATACACTGTCCTGAACTTCAATTCCCAGCAACCCAACCG<br>GCCAACTTCAGCCCCTTCTTCTCCAAGAGCCACAGAAACAGTTTATTCAGAAG<br>TAAAAAAGAAGTGAGCATAATCTGTCCGTCTGTCCTGCTGGCTGCACCAGTGA<br>TGCATTCCCGGATTCTGTTCCTCACTGGAGGGTCTCAGCACACACACACACGT<br>ACACATGCGCGCGCACACACACACACACACACACACACACACACACTTACACA<br>CACACTCATGCATTCACTCTATTGACTCCTTCAGTGTCTATAGAAGAAAAGGT |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | GGATCCTGGAGCCTACAGAAAACTCAACCCTTCTAGGCTTTCAAATTTGGCTG<br>AGAGTGAGGTATCAAAATTTCTCACCCTTTCACTTTCCTGACCCAGATTGTTG<br>AAAATTGACCTATTCAGAGCACCTTCATTCCCCTCCCAACTCCAAGTCCTGCC<br>CTATCAGAGTCTGACTTGAATTTCCATAAACCTTGGAGGTCACCTAAGTGCTT<br>ACGCCAAACAAAACAAAACAAAACAAAACAAAACAAAACAAAACAAAACAAAA<br>CAAACCAGAAGCAGGAAATGGCCAGTCCCATATCTTTAAAGGCTGATTGGAAG<br>CCACCATACATGAGAAGATCAAACCTCCATGGGCAATCTACACACCCGACAAC<br>TGTCATGCTTACCCATCTGGGACATTCGAGTCTCTGAACCTTGTGCCCTCACG<br>CCTGAGCCCTTCTCTGAGCCTTTCTCCAGAAAATCCACTCACAGCAACTAGAG<br>AGGCTCTTTGTCAGCAACTCCAAGCAAACTGCTAGGCAGGATTCAGAAGAAAA<br>GACAGCATCTCTAACATCCACCAGGAAGGTGCCCAGAAAAGCAGAGCTGGTGA<br>CTTTGGACTGACAGACATCTGGAGTGTGAAAAAGCAGCACAGAGCTAACCTTC<br>GGAGAGTGTTGAAATTATTTGAAAAGAAGCCATATTTGGAGGTATTGGAGTTT<br>TCCTCTTTCTGAGACAATCCACTATTTGAAAATTGTAGCTACTGAATTGCCTC<br>TCAGTATGCGAGCTGATCACTTTGCCTTAGGGCCACTAGATTTCTGTCTCCCT<br>TAGCCCCTCAAGCCCTTTTGATCATGAGTTCCAAACCAAAATAAATAAATGA<br>ACAGTGAGGCAGTCCCTTGCAGTACCACTGTCATGGGTCAGGCTAAGCCTCCT<br>GCTTTTCTGAATTAGTCAAGAAAAGCCTTGGTTTCCCTTTTTCCATCTCTTTA<br>TCTTGTCTTTCAGATACTGGCCAGAGCCTGGACACTCTTCCTCTGAGATCTCC<br>AGCTTCTCTGCCTTCTTGTGTTTCTTTTAAACTCTAACAAAACTGTTCTCAC<br>CTTCAAAAAATAAAATAATAACAAGCTTTCCACATCCCCACCAAAGAGGGACC<br>CAGCTAGGTTTCTGGAAACCCAGCACCAGCCTCCAGCTGCCCTTCTGCAGTGT<br>TTCTGCCTCTGTTTCCCTTTCGTTTTGACTTTTTTCCTTCTTTTGAGACAGAG<br>TTCCAGCATGGAGCCTGTGCAGGTTTCAATCCCACAGTAACACCTTCTGCAGC<br>ACCCCACCTGCTCAGACTGCAGCCCTGGCCACCAGGCCTGGCTACCTGGACAT<br>TCTGTCTGCCCTGCACTCTCAGGAAACCTTGGCCTCTGCTACTGTCTGTTTGG<br>CTCATTCAAAGTGTGTCCTTAAAGGAATGCAGTCACCCATGCCAGAGGCAGTG<br>TTTACAGCCTGGAATGCTCTGCACTTCCAGTGGACCAGTGCTCCACCGGAAGT<br>GGGCTGTTAGCAGGGTCCTCTCACCTGGCCCTGGCCTTTCTGTAGCCTTGAAT<br>CCTGCCTTCCCCACCAGGGCACCAGGGATGAGTGCAGCAGCAGGAGGAGAGGC<br>AAACAGTCACCTCAGGAACCTTCTGAGCTAAGGCACACCCTCTGTGCCTGTCA<br>AGCAAAGGTTGTATTGGATATCAAGTGTTTGGTCTCACGCCAAGCCAACAGGC<br>TTTGGAGAGAATTAATTAGTTCTCCTACTCAGGGATTTCTTTCAGTCCTAACA<br>CAGCCTGTGTATATTTTGCTTCACCCACGCAATGCTGGATTATTTAATTTTGC<br>CCGGCTTAAGACAAATCTGAGTTACTTGTAAATTTGCTCTATGTTCATAATAA<br>AAATGTATTATATATCACTGATAGCA (SEQ ID NO: 91)<br><br>>NP_001034274.1 carcinoembryonic antigen-related cell adhesion molecule 1 isoform 1 precursor [*Mus musculus*]<br>MELASAHLHKGQVPWGGLLLTASLLASWSPATTAEVTIEAVPPQVAEDNNVLL<br>LVHNLPLALGAFAWYKGNTTAIDKEIARFVPNSNMNFTGQAYSGREIIYSNGS<br>LLFQMITMKDMGVYTLDMTDENYRRTQATVRFHVHPILLKPNITSNNSNPVEG<br>DDSVSLTCDSYTDPDNINYLWSRNGESLSEGDRLKLSEGNRTLTLLNVTRNDT<br>GPYVCETRNPVSVNRSDPFSLNIIYGPDTPIISPSDIYLHPGSNLNLSCHAAS<br>NPPAQYFWLINEKPHASSQELFIPNITTNNSGTYTCFVNNSVTGLSRTTVKNI<br>TVLEPVTQPFLQVTNTTVKELDSVTLTCLSNDIGANIQWLENSQSLQLTERMT<br>LSQNNSILRIDPIKREDAGEYQCEISNPVSVRRSNSIKLDIIFDPTQGGLSDG<br>AIAGIVIGVVAGVALIAGLAYFLYSRKSGGGSDQRDLTEHKPSASNHNLAPSD<br>NSPNKVDDVAYTVLNFNSQQPNRPTSAPSSPRATETVYSEVKKK (SEQ ID NO: 92) |
| Human BTN3A1 | >NM_007048.6 *Homo sapiens* butyrophilin subfamily 3 member A1 (BTN3A1), transcript variant 1, mRNA<br>ATTCCTCACGATGACCCGACAGTCTCTGCTTTCTTTTTCCTTTCTTCCAGAAG<br>GAGATTTAACCATAGTAGAAAGAATGGAGAACTATTAACTGCCTTTCTTCTGT<br>GGGCTGTGATTTTCAGAGGGGAATGCTAAGAGGTGATTTTCAATGTTGGGACT<br>CAAAGGTGAAGACACTGAAGGACAGAATTTTTGGCAGAGGAAAGATCTTCTTC<br>GGTCACCATACTTGAGTTAGCTCTAGGGAAGTGGAGGTTTCCATTTGGAATTC<br>TATAGCTTCTTCCAGGTCATAGTGTCTGCCCCCCACCTTCCAGTATCTCCTGA<br>TATGCAGCATGAATGAAAATGGCAAGTTTCCTGGCCTTCCTTCTGCTCAACTT<br>TCGTGTCTGCCTCCTTTTGCTTCAGCTGCTCATGCCTCACTCAGCTCAGTTTT<br>CTGTGCTTGGACCCTCTGGGCCCATCCTGGCCATGGTGGGTGAAGACGCTGAT<br>CTGCCCTGTCACCTGTTCCCGACCATGAGTGCAGAGACCATGGAGCTGAAGTG<br>GGTGAGTTCCAGCCTAAGGCAGGTGGTGAACGTGTATGCAGATGGAAAGGAAG<br>TGGAAGACAGGCAGAGTGCACCGTATCGAGGGAGAACTTCGATTCTGCGGGAT<br>GGCATCACTGCAGGGAAGGCTGCTCTCCGAATACACAACGTCACAGCCTCTGA<br>CAGTGGAAAGTACTTGTGTATTTCCAAGATGGTGACTTCTATGAAAAGCCC<br>TGGTGGAGCTGAAGGTTGCAGCACTGGGTTCTGATCTTCACGTTGATGTGAAG<br>GGTTACAAGGATGGAGGGATCCATCTGGAGTGCAGGTCCACTGGCTGGTACCC<br>CCAACCCCAAATACAGTGGAGCAACAACAAGGGAGAGAACATCCCGACTGTGG<br>AAGCACCTGTGGTTGCAGACGGAGTGGGCCTGTATGCAGTAGCAGCATCTGTG<br>ATCATGAGAGGCAGCTCTGGGGAGGGTGTATCCTGTACCATCAGAAGTTCCCT<br>CCTCGGCCTGGAAAAGACAGCCAGCATTTCCATCGCAGACCCCTTCTTCAGGA<br>GCGCCCAGAGGTGGATCGCCGCCCTGGCAGGGACCCTGCCTGTCTTGCTGCTG |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | CTTCTTGGGGGAGCCGGTTACTTCCTGTGGCAACAGCAGGAGGAAAAAAAGAC
TCAGTTCAGAAAGAAAAAGAGAGAGCAAGAGTTGAGAGAAATGGCATGGAGCA
CAATGAAGCAAGAACAAAGCACAAGAGTGAAGCTCCTGGAGGAACTCAGATGG
AGAAGTATCCAGTATGCATCTCGGGGAGAGAGACATTCAGCCTATAATGAATG
GAAAAAGGCCCTCTTCAAGCCTGCGGATGTGATTCTGGATCCAAAAACAGCAA
ACCCCATCCTCCTTGTTTCTGAGGACCAGAGGAGTGTGCAGCGTGCCAAGGAG
CCCCAGGATCTGCCAGACAACCCTGAGAGATTTAATTGGCATTATTGTGTTCT
CGGCTGTGAGAGCTTCATATCAGGGAGACATTACTGGGAGGTGGAGGTAGGGG
ACAGGAAAGAGTGGCATATAGGGGTGTGCAGTAAGAATGTGCAGAGAAAAGGC
TGGGTCAAAATGACACCTGAGAATGGATTCTGGACTATGGGCTGACTGATGG
GAATAAGTATCGGACTCTAACTGAGCCCAGAACCAACCTGAAACTTCCTAAGC
CCCCTAAGAAAGTGGGGGTCTTCCTGGACTATGAGACTGGAGATATCTCATTC
TACAATGCTGTGGATGGATCGCATATTCATACTTTCCTGGACGTCTCCTTCTC
TGAGGCTCTATATCCTGTTTTCAGAATTTTGACCTTGGAGCCCACGGCCCTGA
CTATTTGTCCAGCGTGAAAAGAAGAAGAGAGTTCCTCCAATTCTGACCGAGTG
CTGATCATTCCCTAGAGACACCAGTAACCCCGGGCTTAGCTAACGAAAGTGGG
GAGCCTCAGGCTGAAGTAACTTTTCTCTGCTTCTCCCTGCCCAGCTCAGAGCT
GAGGGCCTCCCCCTCCACAGCAACCAATCACAACCATAAAGCTACAAGCACGC
ACTGAAGCACTTTACTGATACTCATTCAATTATTCATATGACAGTTGTTTGAG
TTTGGTACCATCTTATTTTCCCCTTATACAGATAAGGAAACTGGGGTGCAGAA
AAGTGAATTGACTACAAAGTAGACATGACTAGTTAACAACACAGCTGGGATCT
AAACAGCAATAACTAACATTAATGGAGAACTTAAAATGCTCTGAGTGCTGTGT
TATGAGCTTTGGTGGATGTCACTCCTTTAATCCTCGCAACACCCTGTCGGGTA
GTCTCATTTAGCAAGTATGGAAGTTGAGGCAGGGCAACATTAAGCAACTTACA
TAACTCATGCAGTAATTTCTGCAGTTGGGAGATGTTCAGCTTCAGTCCCCGGC
CCTATGGCCGTTCTTTTCCACCCTGTTTCTTCCCCATAGGAAGAACCCACCT
GTAGCCCTGAGGTTCTTTTCCCAGGATGGCTCCAGGATAAGGATCACTGTAGG
TGGTTGTGGAGTTGACACCCCTGTTGACTCCTTCCCAGCTGATTGTCAGAGCC
TTAGACCCAGCACGCCTTGGATTAGCTCTGCAGAGTGTCTTGGTTGAGAGAAT
AACCTCACCGTACCCACATGACACGTGATTTGGAAAGAGACTAGAGGCCACAC
TTGATAAATCATGGGGAACAGATGTGTTCCACCCAACAAATGTGATAAGTGAT
CATGCAGCCAGAGCCAGCCTTCCTTCAATCAAGGTTTCCAGGCAGAGCAAATA
CCCTAGAGATTCTCTGTGATATAGGAAATTTGGATGAAGGGAGCTAGAAGAAA
TACAGGGATTTTTTTTTTTTTAAGATGGAGTCTTACTCTGTTGCTAGGCTG
GAGTGCAGTGGTGCGATCTCAGCTCCCTGCAACCTCCACCTCCTGGGTTCAAA
CAATTCTCCTGCCTCAGCCTCCCGAGTACTGGGAATATAGGTGCACGCCACCA
CACCCAACAAATTTTTGTACTTTTAGTACAGATGAGGGTTCACTATGTTGGCC
AGGATGGTCTCGATCTCTTGACCTCATGATCCACCCACCTCGGTCTCCCAAAG
TGCTGGGATTACAGGCTTGAGCCACCGGGTGACCGGCTTACAGGGATATTTTT
AATCCCGTTATGGACTCTGTCTCCAGGAGAGGGTCTATCCACCCCTGCTCAT
TGGTGGATGTTAAACCAATATTCCTTTCAACTGCTGCCTGCTAGGGAAAAACT
ACTCCTCATTATCATCATTATTATTGCTCTCCACTGTATCCCCTCTACCTGGC
ATGTGCTTGTCAAGTTCTAGTTGTTCAATAAATTTGTTAATAATGCTGA
(SEQ ID NO: 93)

>NP_008979.3 butyrophilin subfamily 3 member A1
isoform a precursor [Homo sapiens]
MKMASFLAFLLLNFRVCLLLLQLLMPHSAQFSVLGPSGPILAMVGEDADLPCH
LFPTMSAETMELKWVSSSLRQVVNVYADGKEVEDRQSAPYRGRTSILRDGITA
GKAALRIHNVTASDSGKYLCYFQDGDFYEKALVELKVAALGSDLHVDVKGYKD
GGIHLECRSTGWYPQPQIQWSNNKGENIPTVEAPVVADGVGLYAVAASVIMRG
SSGEGVSCTIRSSLLGLEKTASISIADPFFRSAQRWIAALAGTLPVLLLLLGG
AGYFLWQQQEEKKTQFRKKKREQELREMAWSTMKQEQSTRVKLLEELRWRSIQ
YASRGERHSAYNEWKKALFKPADVILDPKTANPILLVSEDQRSVQRAKEPQDL
PDNPERFNWHYCVLGCESFISGRHYWEVEVGDRKEWHIGVCSKNVQRKGWVKM
TPENGFWTMGLTDGNKYRTLTEPRTNLKLPKPPKKVGVFLDYETGDISFYNAV
DGSHIHTFLDVSFSEALYPVFRILTLEPTALTICPA (SEQ ID NO: 94) |
| Human BTN3A2 | >NM_007047.5 Homo sapiens butyrophilin subfamily 3
member A2 (BTN3A2), transcript variant 1, mRNA
GACTCTTACTGTTTCTCATGGTGAGAAGACAATATTTGCTTTCTCTTTTTCCT
TTCTTCCGGATGAGAGGCTAAGCCATAATAGAAAGAATGGAGAATTATTGATT
GACCGTCTTTATTCTGTGGGCTCTGATTCTCCAATGGGAATACCAAGGGATGG
TTTTCCATACTGGAACCCAAAGGTAAAGACACTCAAGGACAGACATTTTTGGC
AGAGCATAGATGAAAATGGCAAGTTCCCTGGCTTTCCTTCTGCTCAACTTTCA
TGTCTCCCTCCTCTTGGTCAGCTGCTCACTCCTTGCTCAGCTCAGTTTTCTG
TGCTTGGACCCTCTGGGCCCATCCTGGCCATGGTGGGTGAAGACGCTGATCTG
CCCTGTCACCTGTTCCCGACCATGAGTGCAGAGACCATGGAGCTGAAGTGGGT
AAGTTCCAGCCTAAGGCAGGTGGTGAACGTGTATGCAGATGGAAAGGAAGTGG
AAGACAGGCAGAGTGCACCGTATCGAGGGAGAACTTCGATTCTGCGGGATGGA
ATCACTGCAGGGAAGGCTGCTCTCCGAATACACAACGTCACAGCCTCTGACAG
TGGAAAGTACTTGTGTTATTTCCAAGATGGTGACTTCTATGAAAAGCCCTGG
TGGAGCTGAAGGTTGCAGCACTGGGTTCTAATCTTCACGTCGAAGTGAAGGGT
TATGAGGATGGAGGGATCCATCTGGAGTGCAGGTCCACCGGCTGGTACCCCCA
ACCCCAAATACAGTGGAGCAACGCCAAGGGAGAGAACATCCCAGCTGTGGAAG |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | CACCTGTGGTTGCAGATGGAGTGGGCCTATATGAAGTAGCAGCATCTGTGATC<br>ATGAGAGGCGGCTCCGGGGAGGGTGTATCCTGCATCATCAGAAATTCCCTCCT<br>CGGCCTGGAAAAGACAGCCAGCATTTCCATCGCAGACCCCTTCTTCAGGAGCG<br>CCCAGCCCTGGATCGCAGCCCTGGCAGGGACCCTGCCTATCTTGCTGCTGCTT<br>CTCGCCGGAGCCAGTTACTTCTTGTGGAGACAACAGAAGGAAATAACTGCTCT<br>GTCCAGTGAGATAGAAAGTGAGCAAGAGATGAAAGAAATGGGATATGCTGCAA<br>CAGAGCGGGAAATAAGCCTAAGAGAGAGCCTCCAGGAGGAACTCAAGAGGAAA<br>AAAATCCAGTACTTGACTCGTGGAGAGGAGTCTTCGTCCGATACCAATAAGTC<br>AGCCTGATGCTCTAATGGAAAAATGGCCCTCTTCAAGCCTGGTGAGGAAATGC<br>TTCAGATGAGGCTCCACCTTGTTAAATAAATTGGATGTATGGAAAAATAGACT<br>GCAGAAAAGGGGAACTCATTTAGCTCACGAGTGGTCGAGTGAAGATTGAAAAT<br>TAACCTCTGAGGGCCAGCACAGCAGCTCATGCCTGTAATCCTAGCACTTTGGA<br>AGGCTGAGGAGGGCGGATCACAAGGTCAGGAGATCAAGACCATCCTGGCTAAC<br>ACGGTGAAACCCCGTCTCTACTAAAAATACAAAAAATAAAAAATTAGCCGGGC<br>ATGGTGACGGGCACCTGTAGTCCCAGCTACTCGGGAGGCTGAGGCAGGAGAAT<br>GGCATGAACCCGGAAGGCAGAGCTTGCAGTGAGCCGAGATCACGCCACTGCAC<br>TCCAGCCTGGGAGACAGAGCGAGACTCTGTCTCAAGAAAAAAAAAAAAAAAAA<br>AAAAGAAAAGAAAATTAACCTCTGAGTATAAAGCATCAGTGGGCAGAATCAAT<br>GTGGGGAGGGAAACAACAAAAATGTAGAAAGAGGATCCTTGTTGCTTCTTGGG<br>GCCGCATCAGGGTATTGGGTTAGGCAGATACTGACCTTACTTTCATTTCCCCT<br>CTGGTCACTAGACCCCTGGGGCTTTCACCAATGACATTGATGAGAGAATCACA<br>TTCAGGGCAGGCTAGGGACACGGGGTTCTGGAAGGACCTCCTCAGCATGGCCC<br>AAGCCTTGCATGCTGTGGCTCTTAAATCCAGGAAAAATGGCTGACCCCATGGA<br>CACCTCCTCAAACTCTCTGCAGCAGATGTAATTCTGTATCCAGACATGGCAAA<br>TGCCATCCTCCTTGTTTCTGAGGACCAGAGGAGTGTACAGCGTGCTGAGGAGC<br>CCCATGACCTACCAGACAACCCTGAGAGATTTGAATGGCGTTACTGTGTGCTT<br>GGCTGTGAAAGCTTCATGTCAGAGAGACACTACTGGGAGGTGGAAGTGGGGGA<br>CAGAAAAGAGTGGCATATTGGGGTATGTAGTAAGAACGTGGAGAGGAAAAAAG<br>TTTGGGTCAAAATGACACCGGAGAACGGATACTGGACTATGGGCCTGACTGAT<br>GGGAATAAGTATCGGGCTCTCACTGAGCCCAGAACCAACCTGAAACTTCCTGA<br>GCCTCCTAGGAAAGTGGGGGTCATCCTGGACTATGAGACTGGACATATCTCGT<br>TCTACAATGCCACGGATGGATCTCATATCTACACATTTCTGCACGCCTCTTCC<br>TCTGAGCCTCTGTATCCTGTATTCAGAATTTTGACCTTGGAGCCCACTGCCCT<br>GACCGTTTGCCCAATACCAAAAGTAGAGAGTTCCCCCGATCCCGACCTAGTGC<br>CTGATCATTCCCTGGAGATACCACTGACCCCAGGCTTAGCTAATGAAAGTGGG<br>GAGCCTCAGGCTGAAGTAACATCTCTGCTTCTCCCTGCCCAGCCTGGAGCTAA<br>GGGTCTCACCCTCCACAACAGCCAGTCAGAACCATAAAGCTACAGGCACACAC<br>TGAAGCACTTTACTGATATTCATTCAATTATTCCATAGGACAGTTGTTTGAGT<br>TTGGTGCCACCTTATTGGCCCCTTTATACAGATAAGGAAACTGGGGTGTAGAA<br>AAGTGTATTGACTTTACAAAGCAGACAGGAATAGTGAACAACAGAGCTGGGAT<br>CTGAACAACAATGACTAACATTAATGGAGAATTTAAAACGTTCTGAGTGCTGT<br>GTTATGAGCTTTGGTGGGTGTCACTCCTTTAATCCTCACAACACCCTGTCAGG<br>TAGTCTCATTTGGCAAGTATGGAAGCAGAGGCAGGGCAACATTAAGTAGCTTA<br>CATAACTCACACGGTAATTTGTGCAGTTGGGAGATGTTCAGCTTCAGTCCCTG<br>GCCAATTGCCCGTTCTTTTCCAGCCTGATTTTTCCTGCATGGGAAGAGCCCAC<br>ATGTAGCCCTGAGGTTCCCTTCCCAGGACAGCTCCAGGATCGAGATCACTGTG<br>AGTGGTTGTGGAGTTAAGACCCCTATGGACTCCTTCCCAGCTGATTATCAGAG<br>CCTTAGACCCAGCACTCCTTGGATTGGCTCTGCAGAGTGTCTTGGTTGAGAGA<br>ATAACGTTGCAGTTCCCACAGGGCATGTGACTTTGAAAGAGACTAGAGGCCAC<br>ACTCAGTTAATAATGGGGCACAGATGTGTTCCCACCCAACAAATGTGATAAGT<br>GATCGTGCAGCCAGAGCCAGCCTTCCTTCAGTCAAGGTTTCCAGGCAGAGCAA<br>ATACCCTAGAGATTCTCTGTAATATTGGTAATTTGGATGAAGGAAGCTAGAAG<br>AATTACAGGGATGTTTTTAATCCCACTATGGACTCAGTCTCCTGGAAAAGGAT<br>CTGTCCACTCCTGGTCATTGGTGGATGTTAAACCCATATTCCTTTCAACTGCT<br>GCCTGCTAGGGAAAACTGCTCCTCATTATCATCACTATTATTGCTCACCACTG<br>TATCCCCTCTACTGGGCAAGTGCTTGTCAAGTTCTAGTTGTTCAATAAATTTG<br>TTAATAATGCTGA (SEQ ID NO: 95)<br><br>>NP_008978.2 butyrophilin subfamily 3 member A2 isoform a precursor [Homo sapiens]<br>MKMASSLAFLLLNFHVSLLLVQLLTPCSAQFSVLGPSGPILAMVGEDADLPCH<br>LFPTMSAETMELKWVSSSLRQVVNVYADGKEVEDRQSAPYRGRTSILRDGITA<br>GKAALRIHNVTASDSGKYLCYFQDGDFYEKALVELKVAALGSNLHVEVKGYED<br>GGIHLECRSTGWYPQPQIQWSNAKGENIPAVEAPVVADGVGLYEVAASVIMRG<br>GSGEGVSCIIRNSLLGLEKTASISIADPFFRSAQPWIAALAGTLPILLLLAG<br>ASYFLWRQQKEITALSSSEIESEQEMKEMGYAATEREISLRESLQEELKRKKIQ<br>YLTRGEESSSDTNKSA (SEQ ID NO: 96) |
| Human BTN2A1 | >NM_007049.5 Homo sapiens butyrophilin subfamily 2 member A1 (BTN2A1), transcript variant 1, mRNA<br>AGATTTCGTTTCCTGCATCTCCAAACATGGCGACCTAGGAGAAGGGGAAGAAC<br>AATTTTTTCTCCTCTTTTGGGAAGGTTTGTGTCTAGTAGTGCCTGTGCCCCTG<br>GGCAGATTGGAGAGAAGAGGGACGACTGGAGAATCGTCGAGAACCAGCGGAGA<br>AAAGAAAAAGCAACGTTTAATTCTAGAAGGCCTCCTGTCCCTGCCTGCTCTGG<br>GTGCTCATGGAATCAGCTGCTGCCCTGCACTTCTCCCGGCCAGCCTCCCTCCT |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | CCTCCTCCTCCTCAGCCTGTGTGCACTGGTCTCAGCCCAGTTTATTGTCGTGG<br>GGCCCACTGATCCCATCTTGGCCACGGTTGGAGAAAACACTACGTTACGCTGC<br>CATCTGTCACCCGAGAAAAATGCTGAGGACATGGAGGTGCGGTGGTTCCGGTC<br>TCAGTTCTCCCCCGCAGTGTTTGTGTATAAAGGTGGCAGAGAGAGAACAGAGG<br>AGCAGATGGAGGAGTACCGAGGAAGAACCACCTTTGTGAGCAAAGACATCAGC<br>AGGGGCAGCGTGGCCCTGGTCATACACAACATCACAGCCCAGGAAAACGGCAC<br>CTACCGCTGTTACTTCCAAGAAGGCAGGTCCTACGATGAGGCCATCCTGCACC<br>TCGTAGTGGCAGGACTAGGCTCTAAGCCCCTCATTTCAATGAGGGGCCATGAA<br>GACGGGGGCATCCGGCTGGAGTGCATATCTAGAGGGTGGTACCCAAAGCCCCT<br>CACAGTGTGGAGGGACCCCTACGGTGGGGTTGCGCCTGCCCTGAAAGAGGTCT<br>CCATGCCTGATGCAGACGGCCTCTTCATGGTCACCACGGCTGTGATCATCAGA<br>GACAAGTCTGTGAGGAACATGTCCTGCTCTATCAACAACACCCTGCTCGGCCA<br>GAAGAAAGAAAGTGTCATTTTTATTCCAGAATCCTTTATGCCCAGTGTGTCTC<br>CCTGTGCAGTGGCCCTGCCTATCATTGTGGTTATTCTGATGATACCCATTGCC<br>GTATGCATCTATTGGATCAACAAACTCCAAAAGGAAAAAAAGATTCTGTCAGG<br>GGAAAAGGAGTTTGAACGGGAAACAAGAGAAATTGCTCTAAAGGAACTGGAGA<br>AAGAACGTGTGCAAAAAGAGGAAGAACTTCAAGTAAAAGAGAAACTTCAAGAA<br>GAATTGCGATGGAGAAGAACATTCTTACATGCTGTTGATGTGGTCCTGGATCC<br>AGACACCGCTCATCCCGATCTCTTCCTGTCAGAGGACCGAGAAGTGTGAGAA<br>GGTGCCCCTTCAGGCACCTAGGGGAGAGCGTGCCTGACAACCCAGAGAGATTC<br>GACAGTCAGCCTTGTGTCCTAGGCCGGGAGAGCTTCGCTTCAGGGAAACATTA<br>CTGGGAGGTGGAGGTGGAAAACGTGATTGAGTGGACTGTGGGGGTCTGTAGAG<br>ACAGTGTTGAGAGGAAAGGGGAGGTCCTGCTGATTCCTCAGAATGGCTTCTGG<br>ACCTTGGAGATGCATAAAGGGCAATACCGGGCCGTGTCCTCCCCTGATAGGAT<br>TCTCCCTTTGAAGGAGTCCCTTTGCCGGGTGGGCGTCTTCCTGGACTATGAAG<br>CTGGAGATGTCTCCTTCTACAACATGAGGGACAGATCGCACATCTACACATGT<br>CCCCGTTCAGCCTTTTCCGTGCCTGTGAGGCCCTTCTTCAGGTTGGGGTGTGA<br>GGACAGCCCATCTTCATCTGCCCTGCACTCACAGGAGCCAATGGGGTCACGG<br>TGCCTGAAGAGGGCCTGACACTTCACAGAGTGGGGACCCACCAGAGCCTATAG<br>AATCAATTCCTTGGTCTCACAGCCATGTAGACAAGCCCTGGTCATCTCAGCAG<br>CCACCGCACAACACCCCTGGTGGAAGACACGCCCTCCTCCCCTCTGGTCACAC<br>AAGAGAACATCTTCCAGCTGCCTCTTTCACACCCACTACAGACCTCAGCCCCA<br>GTTTTCTCCTCCTCACTAGGCTGTGTTTTAGTAGTTCCTTTGCTTGTAACTA<br>TGGGATGGGATCCAGGCATAGGGAACTAGTTGTTACACAGCTCCCAGCCAAGA<br>AGAAAGTGTGAGAAGTTGATGGGCAGCAAACCTGCTGTTTAACATCAGGGTGA<br>CCACATTAAGCCCAGTATTCCAGTTGGCACCAGAAGATATGGACTTGGAATGA<br>GGCCTACAGGGTTCACCAGGATGTAAGAGGAGAGAGGAATCCACAGGACCACC<br>AGAGAGGAGAGGGAACCAGATATGCAGATCAGAGATAGAGGAAGTGGAACCAG<br>AGAGCTGGGAGGGACCAAGGTTGTAAGGGTGGCTAAGTCCCACCATAACAGCT<br>AAGGGGACCTGGGAGATGATGGCTCATTTCCACCCAGCCCCAGGATTTCCAGA<br>GCGCACATCCACAGGCCTGGACCTGGGATGAAGATGAATGAAGAACATGGATG<br>CACGTGGATGTAGTTTGGCTCAGGTGTCCCTGCAGTTGGCAAGGAGTCAGTAC<br>TCAGTCCCTGAGTGTGGCTGAAATTTGAGGTCCTGGCTGAGCCAAGGAGTAAT<br>GGACCAGATCTACCTCAGTATTCAAGTTCAGTGGGACACCAGTGGCTTCAAA<br>CTTCCTGGTTTCATGATATCTTGAGACGCCTTACAAATGATGGAGGATTCCAA<br>AGAGTTTTTGTTTATTTGGGTTAATATTTGTTGGTATTTATGGCATTTGAGAT<br>TGAAACTAAGAAATGTTTTAATTTATTACCTTTACAACATTTATTTACATTAC<br>ATACATACATTTACAACATTTATTAATTTATATTAAAATAGCATGAATAAGCC<br>AATTATAGGTTAATATAAGTAGAATGTTTGTGAAAAATAAGTATGGTATCCAA<br>AGCAAAATAAATTTTATTGTGAAGTGTG (SEQ ID NO: 97)<br><br>>NP_008980.1 butyrophilin subfamily 2 member A1<br>isoform 1 precursor [*Homo sapiens*]<br>MESAAALHFSRPASLLLLLLSLCALVSAQFIVVGPTDPILATVGENTTLRCHL<br>SPEKNAEDMEVRWFRSQFSPAVFVYKGGRERTEEQMEEYRGRTTFVSKDISRG<br>SVALVIHNITAQENGTYRCYFQEGRSYDEAILHLVVAGLGSKPLISMRGHEDG<br>GIRLECISRGWYPKPLTVWRDPYGGVAPALKEVSMPDADGLFMVTTAVIIRDK<br>SVRNMSCSINNTLLGQKKESVIFIPESFMPSVSPCAVALPIIVVILMIPIAVC<br>IYWINKLQKEKKILSGEKEFERETREIALKELEKERVQKEEELQVKEKLQEEL<br>RWRRTFLHAVDVVLDPDTAHPDLFLSEDRRSVRRCPFRHLGESVPDNPERFDS<br>QPCVLGRESFASGKHYWEVEVENVIEWTVGVCRDSVERKGEVLLIPQNGFWTL<br>EMHKGQYRAVSSPDRILPLKESLCRVGVFLDYEAGDVSFYNMRDRSHIYTCPR<br>SAFSVPVRPFFRLGCEDSPIFICPALTGANGVTVPEEGLTLHRVGTHQSL<br>(SEQ ID NO: 98) |
| Human BTNL8 | >NM_001040462.3 *Homo sapiens* butyrophilin like 8<br>(BTNL8), transcript variant 2, mRNA<br>AGAACAGCGCAGTTTGCCCTCCGCTCACGCAGAGCCTCTCCGTGGCTTCCGCA<br>CCTTGAGCATTAGGCCAGTTCTCCTCTTCTCTCTAATCCATCCGTCACCTCTC<br>CTGTCATCCGTTTCATGCCGTGAGGTCCATTCACAGAACATCCATGGCTC<br>TCATGCTCAGTTTGGTTCTGAGTCTCCTCAAGCTGGGATCAGGGCAGTGGCAG<br>GTGTTTGGGCCAGACAAGCCTGTCCAGGCCTTGGTGGGGAGGACGCAGCATT<br>CTCCTGTTTCCTGTCTCCTAAGACCAATGCAGAGGCCATGGAAGTGCGGTTCT<br>TCAGGGGCCAGTTCTCTAGCGTGGTCCACCTCTACAGGGACGGGAAGGACCAG<br>CCATTTATGCAGATGCCACAGTATCAAGGCAGGACAAAACTGGTGAAGGATTC |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | TATTGCGGAGGGGCGCATCTCTCTGAGGCTGGAAAACATTACTGTGTTGGATG<br>CTGGCCTCTATGGGTGCAGGATTAGTTCCCAGTCTTACTACCAGAAGGCCATC<br>TGGGAGCTACAGGTGTCAGCACTGGGCTCAGTTCCTCTCATTTCCATCACGGG<br>ATATGTTGATAGAGACATCCAGCTACTCTGTCAGTCCTCGGGCTGGTTCCCCC<br>GGCCCACAGCGAAGTGGAAAGGTCCACAAGGACAGGATTTGTCCACAGACTCC<br>AGGACAAACAGAGACATGCATGGCCTGTTTGATGTGGAGATCTCTCTGACCGT<br>CCAAGAGAACGCCGGGAGCATATCCTGTTCCATGCGGCATGCTCATCTGAGCC<br>GAGAGGTGGAATCCAGGGTACAGATAGGAGATACCTTTTTCGAGCCTATATCG<br>TGGCACCTGGCTACCAAAGTACTGGGAATACTCTGCTGTGGCCTATTTTTTGG<br>CATTGTTGGACTGAAGATTTTCTTCTCCAAATTCCAGTGGAAAATCCAGGCGG<br>AACTGGACTGGAGAAGAAAGCACGGACAGGCAGAATTGAGAGACGCCCGGAAA<br>CACGCAGTGGAGGTGACTCTGGATCCAGAGACGGCTCACCCGAAGCTCTGCGT<br>TTCTGATCTGAAAACTGTAACCCATAGAAAAGCTCCCCAGGAGGTGCCTCACT<br>CTGAGAAGAGATTTACAAGGAAGAGTGTGGTGGCTTCTCAGAGTTTCCAAGCA<br>GGGAAACATTACTGGGAGGTGGACGGAGGACACAATAAAAGGTGGCGCGTGGG<br>AGTGTGCCGGGATGATGTGGACAGGAGGAAGGAGTACGTGACTTTGTCTCCCG<br>ATCATGGGTACTGGGTCCTCAGACTGAATGGAGAACATTTGTATTTCACATTA<br>AATCCCCGTTTTATCAGCGTCTTCCCCAGGACCCCACCTACAAAAATAGGGGT<br>CTTCCTGGACTATGAGTGTGGGACCATCTCCTTCTTCAACATAAATGACCAGT<br>CCCTTATTTATACCCTGACATGTCGGTTTGAAGGCTTATTGAGGCCCTACATT<br>GAGTATCCGTCCTATAATGAGCAAAATGGAACTCCCATAGTCATCTGCCCAGT<br>CACCCAGGAATCAGAGAAAGAGGCCTCTTGGCAAAGGGCCTCTGCAATCCCAG<br>AGACAAGCAACAGTGAGTCCTCCTCACAGGCAACCACGCCCTTCCTCCCCAGG<br>GGTGAAATGTAGGATGAATCACATCCCACATTCTTCTTTAGGGATATTAAGGT<br>CTCTCTCCCAGATCCAAAGTCCCGCAGCAGCCGGCCAAGGTGGCTTCCAGATG<br>AAGGGGGACTGGCCTGTCCACATGGGAGTCAGGTGTCATGGCTGCCCTGAGCT<br>GGGAGGGAAGAAGGCTGACATTACATTTAGTTTGCTCTCACTCCATCGGCTA<br>AGTGATCTTGAAATACCACCTCTCAGGTGAAGAACCGTCAGGAATTCCCATCT<br>CACAGGCTGTGGTGTAGATTAAGTAGACAAGGAATGTGAATAATGCTTAGATC<br>TTATTGATGACAGAGTGTATCCTAATGGTTTGTTCATTATATTACACTTTCAG<br>TAA (SEQ ID NO: 99)<br><br>>NP_001035552.1 butyrophilin-like protein 8 isoform 2<br>precursor [Homo sapiens]<br>MALMLSLVLSLLKLGSGQWQVFGPDKPVQALVGEDAAFSCFLSPKTNAEAMEV<br>RFFRGQFSSVVHLYRDGKDQPFMQMPQYQGRTKLVKDSIAEGRISLRLENITV<br>LDAGLYGCRISSQSYYQKAIWELQVSALGSVPLISITGYVDRDIQLLCQSSGW<br>FPRPTAKWKGPQGQDLSTDSRTNRDMHGLFDVEISLTVQENAGSISCSMRHAH<br>LSREVESRVQIGDTFFEPISWHLATKVLGILCCGLFFGIVGLKIFFSKFQWKI<br>QAELDWRRKHGQAELRDARKHAVEVTLDPETAHPKLCVSDLKTVTHRKAPQEV<br>PHSEKRFTRKSVVASQSFQAGKHYWEVDGGHNKRWRVGVCRDDVDRRKEYVTL<br>SPDHGYWVLRLNGEHLYFTLNPRFISVFPRTPPTKIGVFLDYECGTISFFNIN<br>DQSLIYTLTCRFEGLLRPYIEYPSYNEQNGTPIVICPVTQESEKEASWQRASA<br>IPETSNSESSSQATTPFLPRGEM (SEQ ID NO: 100) |
| Human BTN2A2 | >NM_006995.5 Homo sapiens butyrophilin subfamily 2<br>member A2 (BTN2A2), transcript variant 1, mRNA<br>GGGACTTTTTGGACACCCAGAGAACAGGTCCCAGATACCGAGTCCGCAACTCC<br>AAACATCGCGATTAATAGGAGGCCTCTGGTCTCTGCCTGCCCTGGGTGCTCAT<br>GGAACCAGCTGCTGCTCTGCACTTCTCCCTGCCAGCCTCCCTCCTCCTCCTCC<br>TGCTCCTCCTCCTTCTCAGCCTGTGTGCACTGGTCTCAGCCCAGTTTACTGTC<br>GTGGGGCCAGCTAATCCCATCCTGGCCATGGTGGGAGAAAACACTACATTACG<br>CTGCCATCTGTCACCCGAGAAAAATGCTGAGGACATGGAGGTGCGGTGGTTCC<br>GGTCTCAGTTCTCCCCCGCAGTGTTTGTGTATAAGGGTGGGAGAGAGAGAACA<br>GAGGAGCAGATGGAGGAGTACCGGGGAAGAATCACCTTTGTGAGCAAAGACAT<br>CAACAGGGGCAGCGTGGCCCTGGTCATACATAACGTCACAGCCCAGGAGAATG<br>GGATCTACCGCTGTTACTTCCAAGAAGGCAGGTCCTACGATGAGGCCATCCTA<br>CGCCTCGTGGTGGCAGGCCTTGGGTCTAAGCCCCTCATTGAAATCAAGGCCCA<br>AGAGGATGGGAGCATCTGGCTGGAGTGCATATCTGGAGGGTGGTACCCAGAGC<br>CCCTCACAGTGTGGAGGGACCCCTACGGTGAGGTTGTGCCCGCCCTGAAGGAG<br>GTTTCCATCGCTGATGCTGACGGCCTCTTCATGGTCACCACAGCTGTGATCAT<br>CAGAGACAAGTATGTGAGGAATGTGTCCTGCTCTGTCAACAACACCCTGCTCG<br>GCCAGGAGAAGGAAACTGTCATTTTTATTCCAGAATCCTTTATGCCCAGCGCA<br>TCTCCCTGGATGGTGGCCCAGCTGTCATCCTGACCGCATCTCCCTGGATGGT<br>GTCCATGACTGTCATCCTGGCTGTTTTCATCATCTTCATGGCTGTCAGCATCT<br>GTTGCATCAAGAAACTTCAAAGGGAAAAAAAGATTCTGTCAGGGGAAAAGAAA<br>GTTGAACAAGAGGAAAAAGAAATTGCACAGCAACTTCAAGAAGAATTGCGATG<br>GAGAAGAACATTCTTACATGCTGCTGATGTGGTCCTGGATCCAGACACCGCTC<br>ATCCCGAGCTCTTCCTGTCAGAGGACCGGAGAAGTGTGAGGCGGGGCCCCTAC<br>AGGCAGAGAGTGCCTGACAACCCAGAGAGATTCGACAGTCAGCCTTGTGTCCT<br>GGGATGGGAGAGCTTCGCCTCAGGGAAACATTACTGGGAGGTGGAGGTGGAAA<br>ACGTGATGGTGTGGACTGTGGGGTCTGCAGACACAGTGTTGAGAGGAAAGGG<br>GAGGTCCTGCTGATTCCTCAGAATGGCTTCTGGACCCTGGAGATGTTTGGAAA<br>CCAATACCGGGCCCTGTCCTCCCCTGAGAGGATTCTCCCTTTGAAGGAGTCCC<br>TTTGCCGGGTGGGCGTCTTCCTGGACTATGAAGCTGGAGATGTCTCCTTCTAC |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | AACATGAGGGACAGATCGCACATCTACACATGTCCCCGTTCAGCCTTTACTGT<br>GCCTGTGAGGCCCTTCTTCAGGTTAGGGTCTGATGACAGCCCCATCTTCATCT<br>GCCCTGCACTCACAGGAGCCAGTGGGGTCATGGTGCCTGAAGAGGGCCTGAAA<br>CTTCACAGAGTGGGGACCCACCAGAGCCTATAGAATCAATTCCTTGGACTCAC<br>AGCCATGCAGATAAGCCCTGGCCATCTCAGCAGCCACCGCACAACCCCCCTAA<br>TGAAAGACACGCCCTCCTCCCCTCTGGTCACGTAAGAGAACATCTTCCAGCTG<br>CCTTTTTCACACCCACTCCAGCCCTCTGCCCCAGTTTTCTCCTCCTCACTAGT<br>CTGTGGCTTTAGTAGTTCCTTTGCTTGTAATTATGGGATGGGATCCAGGCATA<br>GGGAACTAGTTGTTTCATAGCTCCCAGTCAAAAAGAAAGTGAGAGAAGCTGTT<br>GGGCAGCGAACCTACTGTTTAAAATCAGGATAACCACATTAAGCCCAATATGC<br>CAGTTGGCACCAGATGCTGTGGACTTGGAATGAGGCCAACAGGGTTCACCAGG<br>ATGAGAGAGGAGAGAGGAATCCACAGGACCACCAGAAGGGAGAGGAACCAGA<br>TATGCAGATCAGAGATAGAGGAAGTGGAACCAGAGAGCTGGGAGGGACCAAGG<br>TTGTAAGGATGGCTAAGTCCCACCATAAGAGCTAAAGGGTCCTGGGAGATGAT<br>GGCTCATTTCCACCCAACCCCAGGATTTCCACAGCACACACCCACAGGCCTGG<br>ACCTGGGATGAAGATGAATGAAGAACATGGACTCATGTGGATGTGGTTTGGCT<br>CAGATGTCCCTGCAATAAACAAGGGGTCAGTACTTAGTCCCTGAGTGTGGTTG<br>AGGTTTGAGGTCCTGGTCGAGCAGGGCAGTACTGGACCAGGTCTACGTCAGCA<br>TTCAGGTTCAATGGGGACACCAGTGGCTTCAAACTTCCTGATCTAATTATGTT<br>TTTAGACACTTAGAAGTTATTGAGGACTTTAAAGAGCTTTTGTTTATTTGGGT<br>TAATATTTATGACATTTGACATTGAAACAAAAATTTAAAATGTTATCTTTTAA<br>TTTATGTTAAAATAGCATTAATAAATCAGTTATAGGTTAATGTAGATAGGATG<br>TTTTGTGAAAAAGCAATCTATTGTGTCCAAATAAAAAAACAAAAAGTGTGACA<br>CTGGTTAACTTTTTCCAGATCTCATGTCTGGCTTAATAAGAGATATTTGTATT<br>ATCATATCTGCCTTTGTATTAAACCTATTGGTATATCATAGGTCATGTTAGCT<br>CAAAAAAACTTTACTGCACACTACTGAGAGAATGAGATGAAAAACGATTAATG<br>TTTCATTATTATTATTGTGAAAATATTATTAACACTGGGGACTCCTTAAGAGT<br>ACATCAGAGTTCTCTCTAGGAATCCCAAAACCACATTTTGAAACTAGAATAGT<br>GGATCCTGGAAGTTAATCCATGTGCTGGTTAATTTTAGATGTCAACCTGACTG<br>GATTAAGGAATACCTAGACAGCTGGTACAACATTATTTCTGGGTGTGTCTGTG<br>AGTGTGTTTCCAGAAGAGATTGGCAAGTGAGTCAGTGGGAAATTCTCTCCTTC<br>TGTTGGCTGGGTGCCCAATACAACAAAAAGGCAGAGGAAAGGCAAATTCTTCT<br>CTCCTCTGGAGCTGAGACACTCTTCTTCTTCTGCCCTTGACATCAGAACTCC<br>TGGCTCTCCGGCCTTTGAACTTCAGGACTTGTACCAGGAGGCCCTGGGTTCTC<br>AGGCCTTTGGCTTTGGACTGAGAGTTACACAATCAGCTTCCCTGGTTCTGAGG<br>CTTTCAGACTTAAACTGAGCCATGCTACCAGCATCCCAGGGTCTCCAGCCTAC<br>AGATGAGCTGTTGTGCGATTTCTTAGCCTCCATAATCACATGAGCCAATCTCC<br>TTAATAAATGCCTGCTCATAGATCTGTATCTACATCTATATCTGTATGTGCAT<br>CTATATCTATGCCTATATCTATATCTATATCATATTGATTTTGTCTCTCTGGA<br>GAACCCTGACTAATAAAATGAGGCATCTAAAA (SEQ ID NO: 101)<br><br>>NP_008926.2 butyrophilin subfamily 2 member A2<br>isoform a precursor [Homo sapiens]<br>MEPAAALHFSLPASLLLLLLLLLLSLCALVSAQFTVVGPANPILAMVGENTTL<br>RCHLSPEKNAEDMEVRWFRSQFSPAVFVYKGGRERTEEQMEEYRGRITFVSKD<br>INRGSVALVIHNVTAQENGIYRCYFQEGRSYDEAILRLVVAGLGSKPLIEIKA<br>QEDGSIWLECISGGWYPEPLTVWRDPYGEVVPALKEVSIADADGLFMVTTAVI<br>IRDKYVRNVSCSVNNTLLGQEKETVIFIPESFMPSASPWMVALAVILTASPWM<br>VSMTVILAVFIIFMAVSICCIKKLQREKKILSGEKKVEQEEKEIAQQLQEELR<br>WRRTFLHAADVVLDPDTAHPELFLSEDRRSVRRGPYRQRVPDNPERFDSQPCV<br>LGWESFASGKHYWEVEVENVMWTVGVCRHSVERKGEVLLIPQNGFWTLEMFG<br>NQYRALSSPERILPLKESLCRVGVFLDYEAGDVSFYNMRDRSHIYTCPRSAFT<br>VPVRPFFRLGSDDSPIFICPALTGASGVMVPEEGLKLHRVGTHQSL (SEQ<br>ID NO: 102) |
| Mouse<br>BTN2A2 | >NM_175938.3 Mus musculus butyrophilin, subfamily 2,<br>member A2 (Btn2a2), transcript variant 1, mRNA<br>GAAATTGTGAGACTTGCACGCGGAATGGGTCCTCCGAGGTCTGCTGTCGCGAG<br>TCCCAGCACTTTGCAAGTAATGGAGAACAGAAAATTCTTTCCTCTCTACTGTA<br>GCAGTTTGTTCTCTGGTGGCGACTGTGCTCAGCGACAAGTTGGAGAGTAGAGA<br>AAAGGCAAGATAATCAGCATTTGAGGGTCAGAGAAGAAAAGAAAACGCAGTTA<br>ATTCTAGAAGGTTTTCTGTCCACACGTGACCTAGGTGACTCTGTCCTGAAGAC<br>CTATGGAGCCTACAACTTCCCTGCGTTCTTGCCCGATAGCCTCCCTTCTCTTC<br>TTCTTGGTCCTCAGCCTGTTTGTGCTGGTCTCAGCCCAGTTTACTGTCATAGG<br>ACCAGCTGAGCCCATCCTGGCCATGGTAGGAGAGAATACCACACTACACTGCC<br>ACCTGTCACCAGAGAGAAATGCCGAAGAGATGGAGGTGCGGTGGTTCCGGTGG<br>CGTTTCTTCCCTGCAGTGCTGGTGTACAGAGGCCATCAAGAGAGACCAGAGGA<br>GCAGATGGTGGCATACCGAGGAAGAACCACCTTCATGCGCACAGACATCAGCA<br>AGGGAAGAGTTGCGCTCATTATCCACAATGTCACAGCCTATGACAATGGCATC<br>TACTGCTGTTACTTCCAGGAAGGCAGGTCCTATGACCAGGCAACCATGAAGCT<br>TATGGTGGCAAGCCTTGGCTCTGAGCCACTTATTAAAATGAAGACACTTGAGG<br>ATGGGAGCATCTTGCTAGAGTGCACATCTGAAGGGTGGTACCCAGAGCCCCGA<br>GCTGTGTGGAGAGACCCCTATGATGAAGTTGTACCTGCCCTGGAGGAGGAGTA<br>TACAGCTGACAGAGAAGGCCTCTTCACAGTCACCATGACTATAATCATCAGGG<br>ACTGCTCTGTGAGGAACATGACCCTGCTCTGTCAATAACACTCTGCTCAGCCAG |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | GAGGTGGAAAGTGTGATTCTCATTCCAGAATCCTTCGTGCCCAGCCTTCCTCT<br>GTGGATGGTGGCTGTGGCTGTCACTCTGCCTGTAGTAATGCTGATTCTCCTCA<br>CATCTGGAAGCATCTGCCTTGTCAAGAAACACCGCAGGAAGAAATCTATTCTG<br>TCAGCTGAAAAAGAAGCCGAATATGAAGAGAAGGAAGCTGCACGGCAACTTCA<br>AGAGGAACTGCGATGGAGACGAACCCTCTTACATGCTGCTGACGTGGTCCTGG<br>ACCCAGATACAGCTCATCCTGAGCTCTTCCTGTCAGATGACCAGAGAAGTGTA<br>ATACGAGGCTCTTCGAGGCAGAGTGTGCCTGACAACCCTGAGAGATTTGACTG<br>CCGTCCATGTGTCCTGGGCAGGGAAAGCTTCTCCTCAGGGAAGCATTACTGGG<br>AGGTGGAGGTGGAAAATGTAATGGTGTGGGCCATTGGTGTTTGTAGAGACAGC<br>GTGGAAAGGAAAGGGGAGGCCCTGTTGGTTCCTCAGAATGGCTTCTGGACCCT<br>GGAGATGTTTGGAAGCCAGTATCGAGCCCTGTCCTCCCCAGAAAAGATCATAC<br>CTCTGAAAGAGCGTCTTCACCGTATAGCTGTCTTCCTGGACTGTGAGGGTGGA<br>GATATTTCTTTCTACAACATGAGAGACAGATCACACATTTACACATGTCCTCC<br>TGTGACTTTCACTGGGCCCCTGAGACCCTTCTTTAGGCTTGGTTCTGATGACA<br>GTCCCCTGTTCATCTGTCCAGCATTCACAGGGGCACAGGGAGTTACAATACCT<br>GAGGGTGGCTTATTCCTATATAAGACAAGACCAATTTCTCAGAGCCTTGTAAG<br>GAAGCCATAGCTCTCTACACAGTACCATCTGTTGGAGACTAGACCCCATGTCC<br>TTCAGATACATGGAGCATCTTCCAGCTGCCACCTTCACACATACTTCAGGCC<br>CAGTCCTCAGATTACTACATCATTTCTTCTAACTATGGGCCTAGGTAGAGCCA<br>GTCTTAGGGGACTATTGCTGTAATACAGCTCTCTCCTGAGAAGAAAGTGTGAG<br>AAGGGCAGAAAACTTGGAGTTTCAACATGCTGCTCTGGTCACAGTGGATATCA<br>GGCAAGAGCAACAGGGTGGATCAGGATGTAAGAAGTGAGAACTACAGAGGAAG<br>GAGACAGATAAAGATGAATTGAGGCCGAAGATGGAGGAAATGGACTGAAGAGC<br>TCTGGGGTAAGCCCTATGTGACAGCTGTGGATAGGTAGGAGCTAATGGTCCAT<br>TGATATCCAAAGCCAAAGATTTAAATATCACATAGTGTGTCTGGAGTGTATAT<br>CTGTAGACCTACACATGAGAGGAAACAATCATAGTGATGAACTGGATGTAAGC<br>TGGCTCAGACGTCCCTACAATAAACACTTCTGAGTTCCATGTCTGTGCTCAGT<br>AAGAATGGCTTGAGGCTTGCGGTCCATGCTGAGCAGCCAGGTCCACATGAATC<br>GGATTTACTAGAGTAGGTAGCAGTTCAAGTTCCTTAGGCTCAGGATGTCTTCC<br>TTTCCCCCAAGCCCTTCCCCCTTCAAGATAGGTCTCACTATGTAGACCAGGCC<br>AGCCTCCACCTCCAGAGTTCTGGGATTAAAGACAAGCACAACCATGTCCAGTT<br>TATGAGCTTGTGATATATACAGAAGATTAAGTTCTGTGTTCTTGGGTTAGTAA<br>CTGTTGAGATTTGTTTTGAGTCATGCTCTCACTGGCTAGCACTGCTCTCTTGACT<br>TTCTCTCCCCATCTTTTTGTTATTGCTTTTCAAGACATGGTTTCACTGTGTAT<br>TTCTGGCTGATAAGCTGATTTTGAATTCACAGAGATCTGCCTCTGCCTCCTGA<br>GTGCTGGGATTAAAGGTGTGTTACACTACGCCTGGCTTCACTCTATCTCTTCA<br>GTGTGGGGATTATAGGTTTATACTATCATGCCTAACTAATGTCTGTTGCTGCA<br>TATGACATTTGAACTTTAGAACAGAAAAACAACTATACATATTAATATATATT<br>AAACTAATAATAAGC (SEQ ID NO: 103) |
| | >NP_787952.2 butyrophilin subfamily 2 member A2 isoform 1 precursor [Mus musculus]<br>MEPTTSLRSCPIASLLFFLVLSLFVLVSAQFTVIGPAEPILAMVGENTTLHCH<br>LSPERNAEEMEVRWFRWRFFPAVLVYRGHQERPEEQMVAYRGRTTFMRTDISK<br>GRVALIIHNVTAYDNGIYCCYFQEGRSYDQATMKLMVASLGSEPLIKMKTLED<br>GSILLECTSEGWYPEPRAVWRDPYDEVVPALEEEYTADREGLFTVTMTIIIRD<br>CSVRNMTCSVNNTLLSQEVESVILIPESFVPSLPLWMVAVAVTLPVVMLILLT<br>SGSICLVKKHRRKKSILSAEKEAEYEEKEAARQLQEELRWRRTLLHAADVVLD<br>PDTAHPELFLSDDQRSVIRGSSRQSVPDNPERFDCRPCVLGRESFSSGKHYWE<br>VEVENVMVWAIGVCRDSVERKGEALLVPQNGFWTLEMFGSQYRALSSPEKIIP<br>LKERLHRIAVFLDCEGGDISFYNMRDRSHIYTCPPVTFTGPLRPFFRLGSDDS<br>PLFICPAFTGAQGVTIPEGGLFLYKTRPISQSLVRKP(SEQ ID NO: 104) |
| Human BTN1A1 | >NM_001732.3 Homo sapiens butyrophilin subfamily 1 member A1 (BTN1A1), mRNA<br>AGCTTTCTCACTTGGTAGCAGTGGCCTCTTGTGCCTTTTTCTCCAAGATCACC<br>CAGGCTGAAGCTCCTGAGGGGACTCACATCAGTTATCTTGCTGCTCCAGAAGG<br>GTGGGAGATGGCAGTTTTCCCAAGCTCCGGTCTCCCCAGATGTCTGCTCACCC<br>TCATTCCTCCAGCTGCCCAAACTGGATTCAGCTCCCTTTGACGTGATTGGA<br>CCCCCGGAGCCCATCCTGGCCGTTGTGGGTGAGGACGCCGAGCTGCCCTGTCG<br>CCTGTCTCCGAACGCGAGCGCCGAGCACTTGGAGCTACGCTGGTTCCGAAAGA<br>AGGTTTCGCCGGCCGTGCTGGTGCATAGGGACGGGCGCGAGCAGGAAGCCGAG<br>CAGATGCCCGAGTACCGCGGGCGGGCGACGCTGGTCCAGGACGGCATCGCCAA<br>GGGGCGCGTGGCCTTGAGGATCCGTGGCGTCAGAGTCTCTGACGACGGGGAGT<br>ACACGTGCTTTTTCAGGGAGGATGGAAGCTACGAAGAAGCCCTGGTGCATCTG<br>AAGGTGGCTGCTCTGGGCTCTGACCCTCACATCAGTATGCAAGTTCAAGAGAA<br>TGGAGAAATCTGTCTGGAGTGCACCTCAGTGGGATGGTACCCAGAGCCCCAGG<br>TGCAGTGGAGAACTTCCAAGGGAGAGAAGTTTCCATCTACATCAGAGTCCAGG<br>AATCCTGATGAAGAAGGTTTGTTCACTGTGGCTGCTTCAGTGATCATCAGAGA<br>CACTTCTGCGAAAAATGTGTCCTGCTACATCCAGAATCTCCTTCTTGGCCAGG<br>AGAAGAAAGTAGAAATATCCATACCAGCTTCCTCCCTCCCAAGGCTGACTCCC<br>TGGATAGTGGCTGTGGCTGTCATCCTGATGGTTCTAGGACTTCTCACCATTGG<br>GTCCATATTTTTCACTTGGAGACTATACAACGAAAGACCCAGAGAGAGGAGGA<br>ATGAATTCAGCTCTAAAGAGAGACTCCTGGAAGAACTCAAATGGAAAAAGGCT<br>ACCTTGCATGCAGTTGATGTGACTCTGGACCCAGACACAGCTCATCCCCACCT |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | CTTTCTTTATGAGGATTCAAAATCTGTTCGACTGGAAGATTCACGTCAGAAAC<br>TGCCTGAGAAAACAGAGAGATTTGACTCCTGGCCCTGTGTGTTGGGCCGTGAG<br>ACCTTCACCTCAGGAAGGCATTACTGGGAGGTGGAGGTGGGAGACAGGACTGA<br>CTGGGCAATCGGCGTGTGTAGGGAGAATGTGATGAAGAAAGGATTTGACCCCA<br>TGACTCCTGAGAATGGGTTCTGGGCTGTAGAGTTGTATGGAAATGGGTACTGG<br>GCCCTCACTCCTCTCCGGACCCCTCTCCCATTGGCAGGGCCCCCACGCCGGGT<br>TGGGATTTTCCTAGACTATGAATCAGGAGACATCTCCTTCTACAACATGAATG<br>ATGGATCTGATATCTATACTTTCTCCAATGTCACTTTCTCTGGCCCCCTCCGG<br>CCCTTCTTTTGCCTATGGTCTAGCGGTAAAAAGCCCCTGACCATCTGCCCAAT<br>TGCTGATGGGCCTGAGAGGGTCACAGTCATTGCTAATGCCCAGGACCTTTCTA<br>AGGAGATCCCATTGTCCCCCATGGGGGAGGACTCTGCCCCTAGGGATGCAGAC<br>ACTCTCCATTCTAAGCTAATCCCTACCCAACCCAGCCAAGGGGCACCTTAAGG<br>AATATCTCAGCTCATCTGTTTTCCTTTCCTCTAACCCCTCTCCTCCATAGCCT<br>TCTGAGGCTTCACCTGCTAGCTTTACCCAGTCTGTTTCTTCCTGTTGGGTGGC<br>AATTAATTAATCCTGTGAAGGTTACATTGCTGCTGCTAGAGAGGGTGGGGATT<br>GCACCTTCCAAATCTGTTTCTGTACCAATATTTGGGGATGGAGGGGTGACTC<br>AAACTGCTTCTAGTGTTCTCCTAATCCCTTAAGACTAGAACCTATAGGAAACT<br>ACTTGGAGCAAACTCAAAGGACAGATTAGGGATCGAGATTGGGTCAGGTTAGC<br>ATGGGGTTGTGGTTGAAATATCTTGGTATCCAGGATAAGGGTATGTGGAAAAA<br>CAGGCTTTAGGCAAGTGGAAAATTCAAATGTGCTGTGAAAGGACAATCTCAG<br>GCTGAAATCCCATAAAGGAACTTGGAGGGAATATTATGATGGAGGGAAGTGAG<br>GTGAATCCAGGCACATGATGAACACCTGGCTCATCCATAGAGTTTTCACAGCC<br>TATATCGCAAATTTTCTAAGCCACGTCCTATAGGACAGAGGAGACTGGCCCCA<br>CTTCTATGGGTCTGAGCTGTGGAAAAGGGAGAGCAGAGAGGAACTGAGATGAG<br>CAGGGATGAAGGGTCAGGCAGAAAGCGTGATAGAGGAGAGAATTTTTGACAAA<br>ACTCAAAAGTTGTTTGCACAGCTGTTCTTTGTACCCTGTTCCTTTCTCTGCGC<br>CCTCCTGTTTCTCCCTTGCCTGGAAGTCATTCCACCCTCAATTTGTTGATCCA<br>CAAGTTTCCAGTTGTCCTCTTCTTTTTGTTATAGCATCTCTCTATTTCAAAGA<br>CATTCCTAGAAGTCATCCTTCAGTGATATCACCACTTGCTCAGTCACCATCTC<br>AACCTTATGTCACCTCAGCCCTCATCTCAATGCCCAAACCCCTTACACACACC<br>TTCAGTTAGCTTCAACTGCCTCCGTTTCCACACTGTGCACCTTTCACTTTCCC<br>TACCCAGCTTTCCTACATGCTGCCTCTCCTCAGGGTCCCCTGAATGCTGCATC<br>ATTGTGTTCAGTGCAGCTGGACTGATTGCACCTGTGTATTTGCCCCTGAGCAC<br>TTTCCTTTACACATGTGGCTTGTCTTGCCAATAGACTCCAGGCTTATACCTTC<br>CATTTCCATCGTATTCTCCAGTTTCCAGGATAGACGTTGCTCATCGTCTTTAC<br>CTAATAAATAAGTTTGTCTGATTGCTGAAA (SEQ ID NO: 105)<br><br>>NP_001723.2 butyrophilin subfamily 1 member A1<br>precursor [Homo sapiens]<br>MAVFPSSGLPRCLLTLILLQLPKLDSAPFDVIGPPEPILAVVGEDAELPCRLS<br>PNASAEHLELRWFRKKVSPAVLVHRDGREQEAEQMPEYRGRATLVQDGIAKGR<br>VALRIRGVRVSDDGEYTCFFREDGSYEEALVHLKVAALGSDPHISMQVQENGE<br>ICLECTSVGWYPEPQVQWRTSKGEKFPSTSESRNPDEEGLFTVAASVIIRDTS<br>AKNVSCYIQNLLLGQEKKVEISIPASSLPRLTPWIVAVAVILMVLGLLTIGSI<br>FFTWRLYNERPRERRNEFSSKERLLEELKWKKATLHAVDVTLDPDTAHPHLFL<br>YEDSKSVRLEDSRQKLPEKTERFDSWPCVLGRETFTSGRHYWEVEVGDRTDWA<br>IGVCRENVMKKGFDPMTPENGFWAVELYGNGYWALTPLRTPLPLAGPPRRVGI<br>FLDYESGDISFYNMNDGSDIYTFSNVTFSGPLRPFFCLWSSGKKPLTICPIAD<br>GPERVTVIANAQDLSKEIPLSPMGEDSAPRDADTLHSKLIPTQPSQGAP<br>(SEQ ID NO: 106) |
| Mouse BTN1A1 | >NM_013483.3 Mus musculus butyrophilin, subfamily 1,<br>member A1 (Btn1a1), mRNA<br>AACAGCACACAGCCTTCTTCCTTCTGAAGAGCTCTCTCTTTGGCCCCGGGGTG<br>ACAAGCAGCCCTTTTCACTTGATCACTGTGGCTCTGGCTCCCTTTTCCTCTGG<br>GTCTGTCGAAATCGCCTGAAGCTCTTGGCGGGCTTCATTGCCCCAGTTAGCTC<br>AGAGATGGCAGTTCCCACCAACTCCTGCCTCCTGGTCTGTCTGCTCACCCTCA<br>CTGTCCTACAGCTGCCCACGCTGGATTCGGCAGCTCCCTTCGATGTGACCGCA<br>CCTCAGGAGCCAGTGTTGGCCCCTAGTGGGCTCAGATGCCGAGCTGACCTGTGG<br>CTTTTCCCCAAACGCGAGCTCAGAATACATGGAGCTGCTGTGGTTTCGACAGA<br>CGAGGTCGACAGCGGTACTTCTATACCGGGATGGCCAGGAGCAGGAGGGCCAG<br>CAGATGACGGAGTACCGCGGGAGGGCGACGCTGGCGACAGCCGGGCTTCTAGA<br>CGGCCGCGCTACTCTGCTGATCCGAGATGTCAGGGTCTCAGACCAGGGGGAGT<br>ACCGGTGCCTTTTCAAAGACAACGACGACTTCGAGGAGGCCGCCGTATACCTC<br>AAAGTGGCTGCTGTGGGTTCAGATCCTCAAATCAGTATGACGGTTCAAGAGAA<br>TGGAGAAATGGAGCTGGAGTGCACCTCCTCTGGATGGTACCCAGAGCCTCAGG<br>TGCAGTGGAGAACAGGCAACAGAGAGATGCTACCATCCACGTCAGAGTCCAAG<br>AAGCATAATGAGGAAGGCCTGTTCACTGTGGCAGTTTCAATGATGATCAGAGA<br>CAGCTCCATAAAGAACATGTCCTGCTGCATCCAGAATATCCTCCTTGGCCAGG<br>GGAAGGAAGTAGAGATCTCCTTACCAGCTCCCTTCGTGCCAAGGCTGACTCCC<br>TGGATAGTAGCTGTGGCTATCATCTTACTGGCCTTAGGATTTCTCACCATTGG<br>GTCCATATTTTTCACTTGGAAACTATACAAGGAAAGATCCAGTCTGCGGAAGA<br>AGGAATTTGGCTCTAAAGAGAGACTTCTGGAAGAACTCAGATGCAAAAAGACT<br>GTACTGCATGAAGTTGACGTGACTCTGGATCCAGACACAGCCCACCCCCACCT<br>CTTCCTGTATGAAGATTCAAAGTCAGTTCGATTGGAAGATTCACGTCAGATCC |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | TGCCTGATAGACCAGAGAGATTTGACTCCTGGCCCTGTGTGTTGGGCCGTGAG<br>ACCTTTACTTCAGGGAGACATTACTGGGAGGTGGAGGTGGGAGATAGAACTGA<br>CTGGGCCATTGGTGTGTGTAGGGAGAATGTGGTGAAGAAAGGGTTTGACCCCA<br>TGACTCCTGATAATGGGTTCTGGGCTGTGGAGTTGTATGGAAATGGGTACTGG<br>GCCCTCACCCCACTCAGGACCTCTCTCCGATTAGCAGGGCCCCCTCGCAGAGT<br>TGGGGTTTTTCTGGACTATGACGCAGGAGACATTTCCTTCTACAACATGAGTA<br>ACGGATCTCTTATCTATACTTTCCCTAGCATCTCTTTCTCTGGCCCCTCCGT<br>CCCTTCTTTTGTCTGTGGTCCTGTGGTAAAAAGCCCCTGACCATCTGTTCAAC<br>TGCCAATGGGCCTGAGAAAGTCACAGTCATTGCTAATGTCCAGGACGACATTC<br>CCTTGTCCCCGCTGGGGGAAGGCTGTACTTCTGGAGACAAAGACACTCTCCAT<br>TCTAAACTGATCCCGTTCTCACCTAGCCAAGCGGCACCATAACAAATATTCCA<br>GCTTCACGACTTTGCCTTCCTTTGACTAATCCCTCATGCCCCGAAGCTTCAGC<br>TGTTGGCTTCTTGCAGCCCTGCTTCTTCCTGGTGGATGGAGATTAATTCACAT<br>TGGGAAGGTTAGGTATGTTGCTGCCAGACAAGGCAGGAAGAAAGGCCATCCTA<br>GTTTGTTTCTGTACTAACAGTGGGGAGGAAGAGAGCTGAATCCTAAACTATTT<br>CCAGTGCTCATATTCCTTCAGGCCAGAGCCTATAGAGAAGGATTTGGTACAAT<br>CACTCGAGGGATCAAGAGGCAATTAGGTTGGCATGGAATTATGGCAGAAACAT<br>CTGGAATAGGGGTATGTGGAATGACAGGTTTTAGGTAAGGGAGAACAAAACCA<br>AACCATAGGATGCTGAGAAAGAAAGATCTTGGACTAAACTCCTAAAAAAGCAC<br>TTAGAGAAGATATGACAGGCAAATGAAGTGAATTTGGTCTAATTTGATACACT<br>TGCCCTGTCCCTAGGGTTTTTCAGTTATATCTCAATTTTTTTGTTGTTAATTA<br>CATTTTTGACAGCTTCATACATGTATATAATGCATTCTAATTACTCTCACTCT<br>CCTCTATTCTGTCTTATTTCCCTCCCCTCCCCTCATACCTTCCTTCTTGCTTC<br>AAACCTGGCACACTGAGTTTAATGGGCTATCATGGGAACATGGATTTAGAGCT<br>TTCCTCTGAGCTCAAGAGAGCAGGTGTGACTGAATACAGTGATTTCCCCTCTC<br>CTACAATCAATCAGCAGTCAATAGCTCAGCTGGGAGGGGTAGGGCCTCATGAG<br>ACTTCCCCTATCAAGGCTAAATGTTGAAAGGGCCAGTTTTTAGCACCTGTGAG<br>ATCATGATTGCAAGAGCCCAGAAGACAGCATTGCTCGGTCATTCTCCCTACCC<br>TTTGGCTTTTCTGGTGTTTTGTCCTCTCTTTCAGGATGTGTCTGAACTCTGTA<br>TCTTAAGTTTTCTATGTCATGTTCTATAAGATAGAGGAGACTGGCCCTGCTTG<br>TTTGAGAGCAATGTGAGCAAGCTAGCAAGAGACAGAAAGGAGCGGAGATGAAT<br>AGGGGTAGAGAAATTTTTAAACAAACCCTCCAGGTGTGTGTGTGTGTGTGTG<br>TGTCTTCCTCTTTTTTGACCTCCCTAAAGGTCAATCCAACCTCACATTATTGA<br>CTCCACTAGGTGGGGGTTCTGTGTGTGTGTGTGTGTGTGTGTGTGTGTGTG<br>TGTGTTTTAAGATAGAGGTTTACTATGTAGCTTAGGCTGGCTTTGAATTCCTG<br>ATCCTCCTGCCTCTACCTTCCAAGTGCTGGAAACATAGCCACATCCACCACCC<br>CTATCCAGTCCACCTGGTTTGATTCAGCAACGCTCAGGTAGCATCGCTGTTTG<br>ATCTGGAGCTGCCAGCTCCCTCGGCCCCCACTGCAATGCTTAACCCCCTCACA<br>GGCACCTTCCCTTGCCTAACACTGCCATCCTTTTCCACACTGAGCCATTTGCT<br>CAATGTAGCCTACCCAGGTATCCTGCTTTCTGGTCCCCAAAGTTACACCATGA<br>TGCTCAGCACAGCTGGACAGTTTGTCCCAATTTGTGTGTGTCCTCCTGTTTGT<br>ATGGGACTTCTTTTTGTCAATGGCCTGTGTGTGTATCCAAGCTCTTCCACTTC<br>TATTGTATTTTTCCGGCTTCTAAAACAGATGTTACCAAATAAAGAAAGAGAAA<br>GAAAAAAAA (SEQ ID NO: 107)<br><br>>NP_038511.1 butyrophilin subfamily 1 member A1<br>precursor [Mus musculus]<br>MAVPTNSCLLVCLLTLTVLQLPTLDSAAPFDVTAPQEPVLALVGSDAELTCGF<br>SPNASSEYMELLWFRQTRSTAVLLYRDGQEQEGQQMTEYRGRATLATAGLLDG<br>RATLLIRDVRVSDQGEYRCLFKDNDDFEEAAVYLKVAAVGSDPQISMTVQENG<br>EMELECTSSGWYPEPQVQWRTGNREMLPSTSESKKHNEEGLFTVAVSMMIRDS<br>SIKNMSCCIQNILLGQGKEVEISLPAPFVPRLTPWIVAVAIILLALGFLTIGS<br>IFFTWKLYKERSSLRKKEFGSKERLLEELRCKKTVLHEVDVTLDPDTAHPHLF<br>LYEDSKSVRLEDSRQILPDRPERFDSWPCVLGRETFTSGRHYWEVEVGDRTDW<br>AIGVCRENVVKKGFDPMTPDNGFWAVELYGNGYWALTPLRTSLRLAGPPRRVG<br>VFLDYDAGDISFYNMSNGSLIYTFPSISFSGPLRPFFCLWSCGKKPLTICSTA<br>NGPEKVTVIANVQDDIPLSPLGEGCTSGDKDTLHSKLIPFSPSQAAP (SEQ<br>ID NO: 108) |
| Human TIGIT | >NM_173799.4 Homo sapiens T cell immunoreceptor with<br>Ig and ITIM domains (TIGIT), mRNA<br>ACATCTGCTTCCTGTAGGCCCTCTGGGCAGAAGCATGCGCTGGTGTCTCCTCC<br>TGATCTGGGCCCAGGGGCTGAGGCAGGCTCCCCTCGCCTCAGGAATGATGACA<br>GGCACAATAGAAACAACGGGGAACATTCTGCAGAGAAAGGTGGCTCTATCAT<br>CTTACAATGTCACCTCTCCTCCACCACGGCACAAGTGACCCAGGTCAACTGGG<br>AGCAGCAGGACCAGCTTCTGGCCATTTGTAATGCTGACTTGGGGTGGCACATC<br>TCCCCATCCTTCAAGGATCGAGTGGCCCCAGGTCCCGGCCTGGGCCTCACCCT<br>CCAGTCGCTGACCGTGAACGATACAGGGGAGTACTTCTGCATCTATCACACCT<br>ACCCTGATGGGACGTACACTGGGAGAATCTTCCTGGAGGTCCTAGAAAGCTCA<br>GTGGCTGAGCACGGTGCCAGGTTCCAGATTCCATTGCTTGGAGCCTCAGGCCGC<br>GACGCTGGTGGTCATCTGCACAGCAGTCATCGTGGTGGTCGCGTTGACTAGAA<br>AGAAGAAAGCCCTCAGAATCCATTCTGTGGAAGGTGACCTCAGGAGAAAATCA<br>GCTGGACAGGAGGAATGGAGCCCCAGTGCTCCCTCACCCCCAGGAAGCTGTGT<br>CCAGGCAGAAGCTGCACCTGCTGGGCTCTGTGGAGAGCAGCGGGGAGAGGACT<br>GTGCCGAGCTGCATGACTACTTCAATGTCCTGAGTTACAGAAGCCTGGGTAAC |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | TGCAGCTTCTTCACAGAGACTGGTTAGCAACCAGAGGCATCTTCTGGAAGATA<br>CACTTTTGTCTTTGCTATTATAGATGAATATATAAGCAGCTGTACTCTCCATC<br>AGTGCTGCGTGTGTGTGTGTGTGTATGTGTGTGTGTGTTCAGTTGAGTGAA<br>TAAATGTCATCCTCTTCTCCATCTTCATTTCCTTGGCCTTTTCGTTCTATTCC<br>ATTTTGCATTATGGCAGGCCTAGGGTGAGTAACGTGGATCTTGATCATAAATG<br>CAAAATTAAAAAATATCTTGACCTGGTTTTAAATCTGGCAGTTTGAGCAGATC<br>CTATGTCTCTGAGAGACACATTCCTCATAATGGCCAGCATTTTGGGCTACAAG<br>GTTTTGTGGTTGATGATGAGGATGGCATGACTGCAGAGCCATCCTCATCTCAT<br>TTTTTCACGTCATTTTCAGTAACTTTCACTCATTCAAAGGCAGGTTATAAGTA<br>AGTCCTGGTAGCAGCCTCTATGGGGAGATTTGAGAGTGACTAAATCTTGGTAT<br>CTGCCCTCAAGAACTTACAGTTAAATGGGGAGACAATGTTGTCATGAAAAGGT<br>ATTATAGTAAGGAGAGAAGGAGACATACACAGGCCTTCAGGAGAGACGACAG<br>TTTGGGGTGAGGTAGTTGGCATAGGCTTATCTGTGATGAAGTGGCCTGGGAGC<br>ACCAAGGGGATGTTGAGGCTAGTCTGGGAGGAGCAGGAGTTTTGTCTAGGGAA<br>CTTGTAGGAAATTCTTGGAGCTGAAAGTCCCACAAAGAAGGCCCTGGCACCAA<br>GGGAGTCAGCAAACTTCAGATTTTATTCTCTGGGCAGGCATTTCAAGTTTCCT<br>TTTGCTGTGACATACTCATCCATTAGACAGCCTGATACAGGCCTGTAGCCTCT<br>TCCGGCCGTGTGTGCTGGGGAAGCCCCAGGAAACGCACATGCCCACACAGGGA<br>GCCAAGTCGTAGCATTTGGGCCTTGATCTACCTTTTCTGCATCAATACACTCT<br>TGAGCCTTTGAAAAAAGAACGTTTCCCACTAAAAAGAAAATGTGGATTTTTAA<br>AATAGGGACTCTTCCTAGGGGAAAAAGGGGGGCTGGGAGTGATAGAGGGTTTA<br>AAAAATAAACACCTTCAAACTAACTTCTTCGAACCCTTTTATTCACTCCCTGA<br>CGACTTTGTGCTGGGGTTGGGGTAACTGAACCGCTTATTTCTGTTTAATTGCA<br>TTCAGGCTGGATCTTAGAAGACTTTTATCCTTCCACCATCTCTCTCAGAGGAA<br>TGAGCGGGGAGGTTGGATTTACTGGTGACTGATTTTCTTTCATGGGCCAAGGA<br>ACTGAAAGAGAATGTGAAGCAAGGTTGTGTCTTGCGCATGGTTAAAAATAAAG<br>CATTGTCCTGCTTCCTAAGACTTAGACTGGGGTTGACAATTGTTTTAGCAACA<br>AGACAATTCAACTATTTCTCCTAGGATTTTTATTATTATTATTTTTTCACTTT<br>TCTACCAAATGGGTTACATAGGAAGAATGAACTGAAATCTGTCCAGAGCTCCA<br>AGTCCTTTGGAAGAAAGATTAGATGAACGTAAAAATGTTGTTGTTTGCTGTGG<br>CAGTTTACAGCATTTTTCTTGCAAAATTAGTGCAAATCTGTTGGAAATAGAAC<br>ACAATTCACAAATTGGAAGTGAACTAAAATGTAATGACGAAAAGGGAGTAGTG<br>TTTTGATTTGGAGGAGGTGTATATTCGGCAGAGGTTGGACTGAGAGTTGGGTG<br>TTATTTAACATAATTATGGTAATTGGGAAACATTTATAAACACTATTGGGATG<br>GTGATAAAATACAAAAGGGCCTATAGATGTTAGAAATGGGTCAGGTTACTGAA<br>ATGGGATTCAATTTGAAAAAAATTTTTTTAAATAGAACTCACTGAACTAGATT<br>CTCCTCTGAGAACCAGAGAAGACCATTTCATAGTTGGATTCCTGGAGACATGC<br>GCTATCCACCACGTAGCCACTTTCCACATGTGGCCATCAACCACTTAAGATGG<br>GGTTAGTTTAAATCAAGATGTGCTGTTATAATTGGTATAAGCATAAAATCACA<br>CTAGATTCTGGAGATTTAATATGAATAATAAGAATACTATTTCAGTAGTTTTG<br>GTATATTGTGTGTCAAAAATGATAATATTTTGGATGTATTGGGTGAAATAAAA<br>TATTAACATTA (SEQ ID NO: 109)<br><br>>NP_776160.2 T-cell immunoreceptor with Ig and ITIM domains precursor [Homo sapiens]<br>MRWCLLLIWAQGLRQAPLASGMMTGTIETTGNISAEKGGSIILQCHLSSTTAQ<br>VTQVNWEQQDQLLAICNADLGWHISPSFKDRVAPGPGLGLTLQSLTVNDTGEY<br>FCIYHTYPDGTYTGRIFLEVLESSVAEHGARFQIPLLGAMAATLVVICTAVIV<br>VVALTRKKKALRIHSVEGDLRRKSAGQEEWSPSAPSPPGSCVQAEAAPAGLCG<br>EQRGEDCAELHDYFNVLSYRSLGNCSFFTETG (SEQ ID NO: 110) |
| Mouse TIGIT | >NM_001146325.1:98-823 Mus musculus T cell immunoreceptor with Ig and ITIM domains (Tigit), mRNA<br>ATGCATGGCTGGCTGCTCCTGGTCTGGGTCCAGGGGCTGATACAGGCTGCCTT<br>CCTCGCTACAGGAGCCACAGCAGGCACGATAGATACAAAGAGGAACATCTCTG<br>CAGAGGAAGGTGGCTCTGTCATCTTACAGTGTCACTTCTCCTCTGACACAGCT<br>GAAGTGACCCAAGTCGACTGGAAGCAGGACCAGCTTCTGGCCATTTATAG<br>TGTTGACCTGGGGTGGCATGTCGCTTCAGTCTTCAGTGATCGGGTGGTCCCAG<br>GCCCCAGCCTAGGCCTCACCTTCCAGTCTCTGACAATGAATGACACGGGAGAG<br>TACTTCTGTACCTATCATACGTATCCTGGTGGGATTTACAAGGGGAGAATATT<br>CCTGAAGGTCCAAGAAAGCTCAGTGGCTCAGTTCCAGACTGCCCCGCTTGGAG<br>GAACCATGGCTGCTGTGCTGGGACTCATTTGCTTAATGGTCACAGGAGTGACT<br>GTACTGGCTAGAAAGAAGTCTATTAGAATGCATTCTATAGAAAGTGGCCTTGG<br>GAGAACAGAAGCGGAGCCACAGGAATGGAACCTGAGGAGTCTCTCATCCCCTG<br>GAAGCCCTGTCCAGACACAAACTGCCCCTGCTGGTCCCTGTGGAGAGCAGGCA<br>GAAGATGACTATGCTGACCCACAGGAATACTTTAATGTCCTGAGCTACAGAAG<br>CCTAGAGAGCTTCATTGCTGTATCGAAGACTGGCTAA (SEQ ID NO: 111)<br><br>>NP_001139797.1 T-cell immunoreceptor with Ig and ITIM domains precursor [Mus musculus]<br>MHGWLLLVWVQGLIQAAFLATGATAGTIDTKRNISAEEGGSVILQCHFSSDTA<br>EVTQVDWKQQDQLLAIYSVDLGWHVASVFSDRVVPGPSLGLTFQSLTMNDTGE<br>YFCTYHTYPGGIYKGRIFLKVQESSVAQFQTAPLGGTMAAVLGLICLMVTGVT<br>VLARKKSIRMHSIESGLGRTEAEPQEWNLRSLSSPGSPVQTQTAPAGPCGEQA<br>EDDYADPQEYFNVLSYRSLESFIAVSKTG (SEQ ID NO: 112) |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| Human CD27L (CD70) | >NM_001252.5 *Homo sapiens* CD70 molecule (CD70), transcript variant 1, mRNA<br>AGAGAGGGGCAGGCTGGTCCCCTGACAGGTTGAAGCAAGTAGACGCCCAGGAG<br>CCCCGGGAGGGGGCTGCAGTTTCCTTCCTTCCTTCTCGGCAGCGCTCCGCGCC<br>CCCATCGCCCCTCCTGCGCTAGCGGAGGTGATCGCCGCGGCGATGCCGGAGGA<br>GGGGTTCGGGCTGCTCGGTGCGGCGCAGGCCCTATGGGTGCGTCCTGCGGGCTG<br>CTTTTGGTCCCATTGGTCGCGGGCTTGGTGATCTGCCTCGTGGTGTGCATCCAG<br>CGCTTCGCACAGGCTCAGCAGCAGCTGCCGCTCGAGTCACTTGGGTGGGACGT<br>AGCTGAGCTGCAGCTGAATCACACAGGACCTCAGCAGGACCCCAGGCTATACT<br>GGCAGGGGGGCCCAGCACTGGGCCGCTCCTTCCTGCATGGACCAGAGCTGGAC<br>AAGGGGCAGCTACGTATCCATCGTGATGGCATCTACATGGTACACATCCAGGT<br>GACGCTGGCCATCTGCTCCTCCACGACGGCCTCCAGGCACCACCCCACCACCC<br>TGGCCGTGGGAATCTGCTCTCCCGCCTCCCGTAGCATCAGCCTGCTGCGTCTC<br>AGCTTCCACCAAGGTTGTACCATTGCCTCCCAGCGCCTGACGCCCCTGGCCCG<br>AGGGGACACACTCTGCACCAACCTCACTGGGACACTTTTGCCTTCCCGAAACA<br>CTGATGAGACCTTCTTTGGAGTGCAGTGGGTGCGCCCCTGACCACTGCTGCTG<br>ATTAGGGTTTTTTAAATTTTATTTTATTTTATTTAAGTTCAAGAGAAAAAGTG<br>TACACACAGGGGCCACCCGGGGTTGGGGTGGGAGTGTGGTGGGGGGTAGTGGT<br>GGCAGGACAAGAGAAGGCATTGAGCTTTTTCTTTCATTTTCCTATTAAAAAAT<br>ACAAAAATCA (SEQ ID NO: 113)<br><br>>NP_001243.1 CD70 antigen isoform 1 [*Homo sapiens*]<br>MPEEGSGCSVRRRPYGCVLRAALVPLVAGLVICLVVCIQRFAQAQQQLPLESL<br>GWDVAELQLNHTGPQQDPRLYWQGGPALGRSFLHGPELDKGQLRIHRDGIYMV<br>HIQVTLAICSSTTASRHHPTTLAVGICSPASRSISLLRLSFHQGCTIASQRLT<br>PLARGDTLCTNLTGTLLPSRNTDETFFGVQWVRP (SEQ ID NO: 114) |
| Mouse CD27L (CD70) | >NM_011617.2 *Mus musculus* CD70 antigen (Cd70), mRNA<br>GAAGGTGCCAAAAGCTCCAGGGGATTTCCCTGCCCTCCGAGAAGAGGCCCAGT<br>TCTTCCCCTGCATCGGACATCCCCGAGGTTCAAGGGCAGGTCAAGGCAGGCA<br>GAAGCTTCAAAAGCTCGGCTGAGGAGGCTACAGCTTCCCGCTGCCTTCAGGCC<br>GCTGCTTCCGTGCAGGGATGCCGGAGGAAGGTCGCCCTTGCCCCTGGGTTCGC<br>TGGAGCGGGACCGCGTTCCAGCGCCAATGGCCATGGCTGCTGCTGGTGGTGTT<br>TATTACTGTGTTTTGCTGTTGGTTTCATTGTAGCGGACTACTCAGTAAGCAGC<br>AACAGAGGCTGCTGGAGCACCCTGAGCCGCACACAGCTGAGTTACAGCTGAAT<br>CTCACAGTTCCTCGGAAGGACCCCACACTGCGCTGGGGAGCAGGCCCAGCCTT<br>GGGAAGGTCCTTCACACACGGACCAGAGCTGGAGGAGGGCCATCTGCGTATCC<br>ATCAAGATGGCCTCTACAGGCTGCATATCCAGGTGACACTGGCCAACTGCTCT<br>TCCCCAGGCAGCACCCTGCAGCACAGGGCCACCCTGGCTGTGGGCATCTGCTC<br>CCCCGCTGCGCACGGCATCAGCTTGCTGCGTGGGCGCTTTGGACAGGACTGTA<br>CAGTGGCATTACAGCGCCTGACATACCTGGTCCACGGAGATGTCCTCTGTACC<br>AACCTCACCCTGCCTCTGCTGCCGTCCCGCAACGCTGATGAGACCTTCTTTGG<br>AGTTCAGTGGATATGCCCTTGACCACAACTCCAGGATGACTTGTGAATATTTT<br>TTTTCTTTTCAAGTTCTACGTATTTATAAATGTATATAGTACACATA (SEQ ID NO: 115)<br><br>>NP_035747.1 0D70 antigen [*Mus musculus*]<br>MPEEGRPCPWVRWSGTAFQRQWPWLLLVVFITVFCCWFHCSGLLSKQQQRLLE<br>HPEPHTAELQLNLTVPRKDPTLRWGAGPALGRSFTHGPELEEGHLRIHQDGLY<br>RLHIQVTLANCSSPGSTLQHRATLAVGICSPAAHGISLLRGRFGQDCTVALQR<br>LTYLVHGDVLCTNLTLPLLPSRNADETFFGVQWICP (SEQ ID NO: 116) |
| Human CD30L (CD153) | >NM_001244.4 *Homo sapiens* TNF superfamily member 8 (TNFSF8), transcript variant 1, mRNA<br>GTCATTTTCCTACGCGCCCTCTGACATCAGCCACCTTCTCTGTAGCTAGTTTC<br>TCTGCACACAACTTAATCCCTGGCAATGAAAAATGAACCTCTCCCCCACCCTT<br>GCTGCCGCCTCTGCCTCACGCCCCCAGAGAAGAGTTTCTCCACCAGGCAGCA<br>GGTGAAGGTTTTTTTCCAAGTCACATGATTCAGGATTCAGGGGAGAATCCTT<br>CTTGGAACAGAGATGGGCCCAGAACTGATCAGATGAAGAGAGATAAGGTGTG<br>ATGTGGGGAAGACTATATAAAGAATGGACCCAGGGCTGCAGCAAGCACTCAAC<br>GGAATGGCCCCTCCTGGAGACACAGCCATGCATGTGCCGGCGGGCTCCGTGGC<br>CAGCCACCTGGGGACCACGAGCCGCAGCTATTTCTATTTGACCACAGCCACTC<br>TGGCTCTGTGCCTTGTCTTCACGGTGGCCACTATTATGGTGTTGGTCGTTCAG<br>AGGACGGACTCCATTCCCAACTCACCTGACAACGTCCCCCTCAAAGGAGGAAA<br>TTGCTCAGAAGACCTCTTATGTATCCTGAAAAGGGCTCCATTCAAGAAGTCAT<br>GGGCCTACCTCCAAGTGGCAAAGCATCTAAACAAAACCAAGTTGTCTTGGAAC<br>AAAGATGGCATTCTCCATGGAGTCAGATATCAGGATGGGAATCTGGTGATCCA<br>ATTCCCTGGTTTGTACTTCATCATTTGCCAACTGCAGTTTCTTGTACAATGCC<br>CAAATAATTCTGTCGATCTGAAGTTGGAGCTTCTCATCAACAAGCATATCAAA<br>AAACAGGCCCTGGTGACAGTGTGTGAGTCTGAATGCAAACGAAACACGTATA<br>CCAGAATCTCTCTCAATTCTTGCTGGATTACCTGCAGGTCAACACCACCATAT<br>CAGTCAATGTGGATACATTCCAGTACATAGATACAAGCACCTTTCCTCTTGAG<br>AATGTGTTGTCCATCTTCTTATACAGTAATTCAGACTGAACAGTTTCTCTTGG<br>CCTTCAGGAAGAAAGCGCCTCTCTACCATACAGTATTTCATCCCTCCAAACAC |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | TTGGGCAAAAAGAAAACTTTAGACCAAGACAAACTACACAGGGTATTAAATAG<br>TATACTTCTCCTTCTGTCTCTTGGAAAGATACAGCTCCAGGGTTAAAAAGAGA<br>GTTTTTAGTGAAGTATCTTTCAGATAGCAGGCAGGGAAGCAATGTAGTGTGGT<br>GGGCAGAGCCCCACACAGAATCAGAAGGGATGAATGGATGTCCCAGCCCAACC<br>TCTAATTCACTGTATGGTCTTGATCTATTTCTTCTGTTTTGAGAGCCTCCAGT<br>TAAAATGGGGCTCCAGTACCAGAGCAGCTAGCAACTCTGCCCTAATGGGAAAT<br>GAAGGGGAGCTGGGTGTGAGTGTTTACACTGTGCCCTTCACGGGATACTTCTT<br>TTATCTGCAGATGGCCTAATACTTAGTTGTCCAAGTCGCGATCAAGGACTCTC<br>TCACACAGGAAACTTCCCTATACTGGCAGATACACTTGTGACTGAACCATGCC<br>CAGTTTATGCCTGTCTGACTGTCACTCTGGCACTAGGAGGCTGATCTTGTACT<br>CCATATGACCCCACCCCTAGGAACCCCCAGGGAAAACCAGGCTGGGACAGCCC<br>CCTGTTCCTGAGATGGAAAGCACAAATTTAATACACCACCACAATGGAAAACA<br>AGTTCAAAGACTTTTACTTACAGATCCTGGACAGAAAGGGCATAATGAGTCTG<br>AAGGGCAGTCCTCCTTCTCTAGGTTACATGAGGCAGGAATAAGAAGTCAGACA<br>GAGACAGCAAGACAGTTAACAATGTAGGTAAAGAAATAGGGTGTGGTCACTCT<br>CAATTCACTGGCAAATGCCTGAATGGTCTGTCTGAAGGAAGCAACAGAGAAGT<br>GGGGAATCCAGTCTGCTAGGCAGGAAAGATGCCTCTAAGTTCTTGTCTCTGGC<br>CAGAGGTGTGGTATAGAACCAGAAACCCATATCAAGGGTGACTAAGCCCGGCT<br>TCTGGTATGAGAAATTAAACTTGTATACAAAATGGTTGCCAAGGCAACATAAA<br>ATTATAAGAATTCACTATACCTTCCCCTCCCTGGAACTCAGGATCCAAGTCTA<br>GAAAATGAAAGGACTGGGTTTGAATTGCTTCAAAACCTCTTCCATCTCAGAAG<br>ACCAGACCCTGGGAACTGAGATTCCAGACACAATTTTGGAAGCTCTCCAACCA<br>AAATAAGGCCCCCCTACCCCAGTATATAATTGAAGACACTAGTAACACCTGAC<br>TGCATCTCATCTCAGCAGAGCCAGAATATGGGGACAAGGTTCAGGGTGCCCTG<br>CTGAATGGTGTGAACAGCAGGATCTCAAGGATGTAATGGAAAGAACTACCACA<br>CTGACCATCCAGAATCAAGAGACCATCTGGGTGTTTGGGAAACCATCTGACG<br>AGGCCTGACTCTATTCCAGTTAGATTGACAATAATTGAGCAGCAGGCATTTTT<br>CATTTCTGGTCAGGAAAGCATTGTGCCTTTAGCAAACAATCAGTGTGCAACAG<br>TGATGTGGTCATCTAGCCAGGGAATGGCTGCTCCATCCCCTGCATAATATATT<br>CCTGCTTCAAACACCTCTCAGAAAACCAGTTCCGCGAGGGTTTTTATATCCCC<br>ACAAAGTTGTTGAGAGACAATGATGACCCTGGAAGTGGGGAGGAGGACTTCTG<br>AGAAACAGCAACCTCTCTCCTGATTGGGGTAGCCATGAGATTTCTCTAGCTAT<br>ATCCAACTTGGCATCTGTACATCATCTTTGGAGGAACATCTTATTTGTGGAAG<br>GACCTTGACAAGCCGTTTGAGATGGAATGTAGGCCCTGATGTTATGCTTCAGT<br>AAAAAAAGATGGAAGCTTCCCTGCTATACCAAAACATGGAGCAAAATTTGCAT<br>TTTTCTCAAGAAGGAGAGAAAAGGAGTAGGACTCCAGCAAAGTTTGTCAGAAG<br>GAAAGCTAGAAAAGATTTAAAAGAAAAAAAGAAAGAACAAATCAGCAGTGGTG<br>GTATGGATGAAAGGGACTTGAGAGAACAAAAATGGCTAAGGGAAAATTTTAAG<br>TCATCTGCTGAGCAGTGTGCTGTGTCAACCTCCTCCTAGGTCTCCTCTATGAA<br>ATATTTAGTAAAGTCTACATTTCTCTTTAACTCTTTCTGTGAGTAGATTCTTT<br>GGGAGAAGCAGGCATTGGAAGAGGTGTTGAATTCAGCAAGCCAAATGGTCTGT<br>GGTAAAAAACAAAACAGACTTTGAGACTCAAGGCTAAAAAAACAGGGAAATGG<br>CTGGCATTTGAGTCACACACTAACTGCATAGGACAAATGAATCTTGCTTAAAC<br>CAACTCATGCATTCTTGAAAAGGTATATGCAACCCAACTGTGTGTTAACTAAG<br>CAATTTTTTTGCCATCTCACATTCTAACTCGAGAAAGATTCCATTTTTCATTTT<br>TCACCAACTGTTCTCTGAGCAGAGGTACCTGACTTTTGCACTGTGAGTGGTTT<br>CTAATCTCAGTCTCTGTCAAGCAATGCTAAGAAAGCCAACACCTAAAGACACA<br>AGGGGTACATCATTTAAATGAATAATGTAACCAAACAAACAAAAAAGAGAAT<br>AATCATTAATAACTCAACTGATAGATATGTAGGGAGTAGGCAACCCAGGAAGT<br>TTAAAACTAAATTCTGTTACTCTTGAGGGTTAACCAGCCCCTGGGAATGTTAT<br>GAGCAAATGATACTCCATGAGTAAAATGATATCTATGCAAGTAAAATAAATAA<br>TTTATCTAACTGGGAA (SEQ ID NO: 117)<br><br>>NP_001235.1 tumor necrosis factor ligand superfamily member 8 isoform 1 [Homo sapiens]<br>MDPGLQQALNGMAPPGDTAMHVPAGSVASHLGTTSRSYFYLTTATLALCLVFT<br>VATIMVLVVQRTDSIPNSPDNVPLKGGNCSEDLLCILKRAPFKKSWAYLQVAK<br>HLNKTKLSWNKDGILHGVRYQDGNLVIQFPGLYFIICQLQFLVQCPNNSVDLK<br>LELLINKHIKKQALVTVCESGMQTKHVYQNLSQFLLDYLQVNTTISVNVDTFQ<br>YIDTSTFPPLENVLSIFLYSNSD (SEQ ID NO: 118) |
| Mouse CD30L (CD153) | >NM_009403.3 Mus musculus tumor necrosis factor (ligand) superfamily, member 8 (Tnfsf8), mRNA<br>AGATTAATCCCAGGCGATGAAAAATGAACCTCTCCCCCACCCTTGCAGCCACC<br>CTTCGCCTCACGCCCCAGAGAAGAGTTTCTCCATCCGGCAACTGGTGAAGGC<br>TTTTTTCCAAGTCACATGATCCAGGATGCAGGGGAAATCTTCTTGGAACAG<br>AGCTGGGTACAGAACCGAATCAGATGAGGAGAGATAAGGTGTGATGTGGGACA<br>GACTATATAAAGCATGGAGCCAGGGCTGCAACAAGCAGGCAGCTGTGGGGCTC<br>CTTCCCCTGACCCAGCCATGCAGGTGCAGCCCGGCTCGGTAGCCAGCCCCTGG<br>AGAAGCACGAGGCCCTGGAGAAGCACAAGTCGCAGCTACTTCTACCTCAGCAC<br>CACCGCACTGGTGTGCCTTGTTGTGGCAGTGGCGATCATTCTGGTACTGGTAG<br>TCCAGAAAAGGACTCCACTCCAAATACAACTGAGAGGCCCCCCTTAAAGGA<br>GGAAATTGCTCAGAGGATCTCTTCTGTACCCTGAAAAGTACTCCATCCAAGAA<br>GTCATGGGCCTACCTCCAAGTGTCAAAGCATCTCAACAATACCAAACTGTCAT<br>GGAACGAAGATGGCACCATCCACGGACTCATATACCAGGACGGGAACCTGATA |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | GTCCAATTCCCTGGCTTGTACTTCATCGTTTGCCAACTGCAGTTCCTCGTGCA<br>GTGCTCAAATCATTCTGTGGACCTGACATTGCAGCTCCTCATCAATTCCAAGA<br>TCAAAAAGCAGACGTTGGTAACAGTGTGTGAGTCTGGAGTTCAGAGTAAGAAC<br>ATCTACCAGAATCTCTCTCAGTTTTTGCTGCATTACTTACAGGTCAACTCTAC<br>CATATCAGTCAGGGTGGATAATTTCCAGTATGTGGATACAAACACTTTCCCTC<br>TTGATAATGTGCTATCCGTCTTCTTATATAGTAGCTCAGACTGAATAGTTGTT<br>CTTAACCTTTATGAAAATGCTGTCTACCATACAGTACTTCATCTGTCCAAACA<br>TGGGCCAAAGAAAATATTAGGACAACTCAAACTAAGCATGTGAGTTAGTGCAC<br>TTCTCTTTCTGTCCTTTGGAAAAATACAAACCCAGGATTTAGAAAGTGGAGTC<br>TCCTTCAGATGCACAAACAGGAAAGAATGTGATATGTGCACAGAGACCTACTT<br>GGGCACTAGAAGGGGTTGAGTTGTCCCAGTATAACCACTAATTCACTGACCTT<br>GAGCCATTTTTCCTTCCCCTGGAACTTGGGGTCTGAATCTGGAAAAGTAGGAG<br>ATGAGATTTACATTTCCCCAATATTTTCTTCAACTCAGAAGACGAGACTGTGG<br>AGCTGAGCTCCCTACACAGATGAAGGCCTCCCATGGCATGAGGAAAATGATGG<br>TACCAGTAATGTCTGTCTGACTGTCATCTCAGCAAGTCCTAAGGACTTCCATG<br>CTGCCTTGTTGAAAGATACTCTAACCTCTTGTAATGGGCAAAGTGATCCTGTC<br>TCTCACTGAGGGGAGTAGCTGCTGCCATCTCCTGAGACATACATGGAGACATT<br>TTCTGCCCAAATTCCATTCTGTGTGCAGTTTTTAAGTATTCCCCCAAAAGTTC<br>TTGACAATGAGAACTTTGAATGTGGGAAGAGCTTCTGGACAGCAAACATTAAC<br>AGCTTCTCCTGACCAGAGAGACCATGCAAGCTTGGTCTTAGACCCCATCAAGCT<br>TGAGGTTTCTACATTGTGGGAGACAGACTTTTGACAAACCATTTGAGTTGATG<br>TCTGGGCCCCTGGGAGTTCTCCTTCAGTAAGGAGAGCAAGCCGTTCTAGTGCT<br>GTGTCAGAGGATGGAGTAAAATAGACACTTTTCTGAAGGAAAGGAGAACAAAG<br>TTCCAGAAAAAGGCTAGAAAATGTTTAAAAGGAAAAGAAAAAACTCAGCTTTT<br>CTCATATGAGAGGAACCCAGAAAAACAACACTGAAAAAGAAGAGTGGCTCTGT<br>CAACCTCCTCTTAGGTCTCCTCCTCTCTAGTTATTGGGAAAGGAGTTGCATGG<br>TACAGGACAAGTTCTGGTGTGTGGTCAAATAGAATCAGATGTGGAGAACACCA<br>TGCAGAGAATAAGGAGACCTGTCATATTTGTGTTGTACTCAAATGAGGGGCAA<br>ATGAATCTTAGGCTAAATCAAATAACAGTCTCTGTCAAGCTGTGCTCAGAAAG<br>TCAACCACTGAAGATGGAGGGTGAGGCACGTCATTTAAAAAAAGTGAAATGTA<br>GC (SEQ ID NO: 119)<br><br>>NP_033429.1 tumor necrosis factor ligand superfamily member 8 [*Mus musculus*]<br>MEPGLQQAGSCGAPSPDPAMQVQPGSVASPWRSTRPWRSTSRSYFYLSTTALV<br>CLVVAVAIILVLVVQKKDSTPNTTEKAPLKGGNCSEDLFCTLKSTPSKKSWAY<br>LQVSKHLNNTKLSWNEDGTIHGLIYQDGNLIVQFPGLYFIVCQLQFLVQCSNH<br>SVDLTLQLLINSKIKKQTLVTVCESGVQSKNIYQNLSQFLLHYLQVNSTISVR<br>VDNFQYVDTNTFPLDNVLSVFLYSSSD (SEQ ID NO: 120) |
| Human GITRL | >NM_005092.4 *Homo sapiens* TNF superfamily member 18 (TNFSF18), mRNA<br>ATCACTTGTGAATTTTTGTTTTCCACAGCTCTCATTTCTCCAAAAATGTGTTT<br>GAGCCACTTGGAAAATATGCCTTTAAGCCATTCAAGAACTCAAGGAGCTCAGA<br>GATCATCCTGGAAGCTGTGGCTCTTTTGCTCAATAGTTATGTTGCTATTTCTT<br>TGCTCCTTCAGTTGGCTAATCTTTATTTTTCTCCAATTAGAGACTGCTAAGGA<br>GCCCTGTATGGCTAAGTTTGGACCATTACCCTCAAAATGGCAAATGGCATCTT<br>CTGAACCTCCTTGCGTGAATAAGGTGTCTGACTGGAAGCTGGAGATACTTCAG<br>AATGGCTTATATTTAATTTATGGCCAAGTGGCTCCCAATGCAAACTACAATGA<br>TGTAGCTCCTTTTGAGGTGCGGCTGTATAAAAACAAAGACATGATACAAACTC<br>TAACAAACAAATCTAAAATCCAAATGTAGGAGGGACTTATGAATTGCATGTT<br>GGGGACACCATAGACTTGATATTCAACTCTGAGCATCAGGTTCTAAAAAATAA<br>TACATACTGGGGTATCATTTTACTAGCAAATCCCCAATTCATCTCCTAGAGAC<br>TTGATTTGATCTCCTCATTCCCTTCAGCACATGTAGAGGTGCCAGTGGGTGGA<br>TTGGAGGGAGAAGATATTCAATTTCTAGAGTTTGTCTGTCTACAAAAATCAAC<br>ACAAACAGAACTCCTCTGCACGTGAATTTTCATCTATCATGCCTATCTGAAAG<br>AGACTCAGGGGAAGAGCCAAAGACTTTTGGTTGGATCTGCAGAGATACTTCAT<br>TAATCCATGATAAAACAAATATGGATGACAGAGGACATGTGCTTTTCAAAGAA<br>TCTTTATCTAATTCTTGAATTCATGAGTGGAAAAATGGAGTTCTATTCCCATG<br>GAAGATTTACCTGGTATGCAAAAAGGATCTGGGGCAGTAGCCTGGCTTTGTTC<br>TCATATTCTTGGCTGCTGTAATTCATTCTTCTCATACTCCCATCTTCTGAGA<br>CCCTCCCAATAAAAAGTAGACTGATAGGATGGCCACAGATATGCCTACCATAC<br>CCTACTTTAGATATGGTGGTGTTAGAAGATAAAGAACAATCTGAGAACTATTG<br>GAATAGAGGTACAAGTGGCATAAAATGGAATGTACGCTATCTGGAAATTTCTC<br>TTGGTTTTATCTTCCTCAGGATGCAGGGTGCTTTAAAAAGCCTTATCAAAGGA<br>GTCATTCCGAACCCTCACGTAGAGCTTTGTGAGACCTTACTGTTGGTGTGTGT<br>GTCTAAACATTGCTAATTGTAAAGAAAGAGTAACCATTAGTAATCATTAGGTT<br>TAACCCCAGAATGGTATTATCATTACTGGATTATGTCATGTAATGATTTAGTA<br>TTTTTAGCTAGCTTTCCACAGTTTGCAAAGTGCTTTCGTAAAACAGTTAGCAA<br>TTCTATGAAGTTAATTGGGCAGGCATTTGGGGGAAAATTTTAGTGATGAGAAT<br>GTGATAGCATAGCATAGCCAACTTTCCTCAACTCATAGGACAAGTGACTACAA<br>GAGGCAATGGGTAGTCCCCTGCATTGCACTGTCTCAGCTTTAGAATTGTTATT<br>TCTGCTATCGTGTTATAAGACTCTAAAACTTAGCGAATTCACTTTTCAGGAAG<br>CATATTCCCCTTTAGCCCAAGGTGAGCAGAGTGAAGCTACAACAGATCTTTCC<br>TTTACCAGCACACTTTTTTTTTTTCCTGCCTGAATCAGGGAGATCCAGGAT |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | GCTGTTCAGGCCTTATCCCAACCAAATTCCCTCTTCACTTTGCAGGGCCCAT<br>CTTAGTCAAATGTGCTAACTTCTAAAATAATAAATAGCACTAATTCAAAATTT<br>TTGGACTCTTAAATTAGCTACTTGCAGGTTCTTGTTGAAAGGTATATAATATT<br>ACATTGTAAACAAATTTAAAATATTTATGGATATTTGTGAAAAGCTGCATTAT<br>GTTAAATAATATTACATGTAAAGCTATTTAAAAGAGGTTTTTTTTGTATTTTG<br>TTTAACAAAAATTGCTCAGGAGCATGCTAAGCCTGAGGCCAAGTTGTTTCTTA<br>GTATGACTTTTTAAAAAAAACATCTGCTGAGTAGCTACAGGGCCAAAGACTTGG<br>AGAGCTTGTTTCTGTTGCATTTGCATATCTTCTCAGGAAATTAAAGTGTGTCA<br>TACATATGTGTGTGTGTGTGTGTGTGTGTGTATATGTGTGTGTATATAT<br>ATGTATACTTATAAAATCTTGGTGTTCTTGATCTTTGTTGTGTTATAAGCAAT<br>GTGTGCTGGAGTGGGCTGGTGCTAGCTTATAAGCACATATTATTAAATTTTCA<br>GGAATGTTGCACTTTAGTTATTAACTATAGGCATTCTTGAAATTGGCTATGGT<br>GGGAGTATTTATACCATGTAAATTGGCAAACACTACACATTTTCCTTTTGGAC<br>AGCTAGTTCACCAGCACACCACTGTGAAACTCTCCTTAATGACTCCTCTCTGC<br>CCCCGCTTCATTCCTGGGATAATCATAGCAGACTAAGGGAGAAAATGAAATTG<br>TAAAAATTTGGCATACTGGTGATTTCTCAGGGCAAGCAGAGGTTACTACAGCT<br>GCAGCTAGAGGGATGACTACCAACAGGTGACCTTTACATTTTCCTGATGTTAT<br>AATTTTAGCTTTTGTTTTCAATGTATACTGTTTTCCTGTTTCTCCACATAGTA<br>GTCTGCATTTTAAATCTATAATAAAACATGCTGATAACTGG (SEQ ID NO: 121)<br><br>>NP_005083.3 tumor necrosis factor ligand superfamily member 18 [Homo sapiens]<br>MCLSHLENMPLSHSRTQGAQRSSWKLWLFCSIVMLLFLCSFSWLIFIFLQLET<br>AKEPCMAKFGPLPSKWQMASSEPPCVNKVSDWKLEILQNGLYLIYGQVAPNAN<br>YNDVAPFEVRLYKNKDMIQTLTNKSKIQNVGGTYELHVGDTIDLIFNSEHQVL<br>KNNTYWGIILLANPQFIS (SEQ ID NO: 122) |
| Mouse GITRL | >NM_183391.3 Mus musculus tumor necrosis factor (ligand) superfamily, member 18 (Tnfsf18), mRNA<br>TTGTGGGTATCTGCTTTCCCCAGTTCTCATTCCATCAGAGAACGAGTTCTAGC<br>CTCATGGAGGAAATGCCTTTGAGAGAATCAAGTCCTCAAAGGGCAGAGAGGTG<br>CAAGAAGTCATGGCTCTTGTGCATAGTGGCTCTGTTACTGATGTTGCTCTGTT<br>CTTTGGGTACACTGATCTATACTTCACTCAAGCCAACTGCCATCGAGTCCTGC<br>ATGGTTAAGTTTGAACTATCATCCTCAAAATGGCACATGACATCTCCCAAACC<br>TCACTGTGTGAATACGACATCTGATGGGAAGCTGAAGATACTGCAGAGTGGCA<br>CATATTTAATCTACGGCCAAGTGATTCCTGTGGATAAGAAATACATAAAAGAC<br>AATGCCCCCTTCGTAGTACAGATATATAAAAAGAATGATGTCCTACAAACTCT<br>AATGAATGATTTTCAAATCTTGCCTATAGGAGGGGTTTATGAACTGCATGCTG<br>GAGATAACATATATCTGAAGTTCAACTCTAAAGACCATATTCAGAAAACTAAC<br>ACATACTGGGGATCATCTTAATGCCTGATCTACCATTCATCTCTTAGAGATT<br>GGGTTTGGTCTCCTCATCTTCTTTGTATCCCGAGATGCTGGTGGGTGGGT<br>TGGAGGGGGATGATTGATGGCAATGCACACAGTTTGTGAGGGCTTACAAATTG<br>ACACAATCAGAGCCTCTTGGCATATAAAATTTTAGCCCTCATATCTGTCTGAA<br>GAGGACTCAGCAAATGGGCCAATCCCTAATGTTGGGTCTGCAAATGGACTTGT<br>ACAATCCATGATAAAAAGGAGTATGGGCCACAGAAGACAGAAACTCTTCCAAA<br>GAATGTCTTTCTAACCTTGATCCCTGGGTAGAATGAGATCCTGTTTCCATGGG<br>AGTCTTACTTGGCTTGCAAAAAAGGGTGTAGGGCAGTAGCTTGGCCTTTTTC<br>CATCATAATTTCCTTGAGCTGTTTTACCTTAATCCCTCCAAACTCTCACCTTC<br>TGAGAGCCTCCTAATGAAACATTGTTAGACTGGTGGGGTGGCCAAGACATGCC<br>AACAACACCCTTCTTTAGAGGTGGTGTTTTTAGAGGACAGAGAACATTATGAA<br>GCCTAGAGCAGCAGAGGTCAAGATGCCACGAAATGGAATTGATCTGGGAATTT<br>TTTTTTTTTTTCATTCTCAGGATGCAGGTTCATTCTGAACTTTCCCCTAGGCC<br>TTCATTGCTTTTGTGTGTATGTGTGCATAAATTCTGCAAATAGAAAAATGAGA<br>GTTTGCACCAGTACTCACTAGATTTAACACCAGAAAGTGGTACTTTTCTGGCT<br>GTATTATGCCATGATAGCACATTTTCTGTTGGTGTTCCCTAACTGACAAGTAT<br>AACAGTTTTCCTAAACCACACAACAATGCTATGATGTTAATGGGGTAGATATT<br>TTTGGAAAAAAATTGCACAGTGAGAACATGGGTAGATGAACCCTAAGACTCTT<br>ACCTCAATTCAGAACTCGCAAGGAGTTAAGTGAGTGGGGTCTTCATTAGACCA<br>TTCACATGGTCTCTGCTTTGAAACTGGCGTTGCTACTGTCTCATTATACATCA<br>CTAAAATGGAATTAACTCAACTTTGAAATGGATGCATCGACTTTACCCCAAGG<br>TGTCCAGAATGAAGCTACAAGACTTTTACCAGCAGTCATTTTCCTTTTGCCTG<br>GAGCAAGAAGATCCAGGATACTGTTGGAAGAGTTCATCTCACTCAACCATGCT<br>GACTTTCCAAAGTAATAATGAACATTTGTGTTCAAATTTTGGATTCTGTTAAA<br>TTTAGCCAGCTTGTGAGTTCTTGTCGAAAAGTATTTTAAACCAATTTACACTA<br>TTTATGGGTATTTGTGAAAAGCTATATAGTGATATTTTATATATAACTAATTT<br>AAAATATTTTTATTTTATGTAACAAAAATACTATAGGCTAAGCTATTTCTTCT<br>TATTTTTTTATGAATACTTGCTGAATTGCCATAGGGCACAAAGACTCTTCTGT<br>TTGCATATCTTCTCAGGAAATTAAAATTGTATCACATGTATTTATAAGAA<br>(SEQ ID NO: 123)<br><br>>NP_899247.3 tumor necrosis factor ligand superfamily member 18 [Mus musculus]<br>MEEMPLRESSPQRAERCKKSWLLCIVALLLMLLCSLGTLIYTSLKPTAIESCM<br>VKFELSSSKWHMTSPKPHCVNTTSDGKLKILQSGTYLIYGQVIPVDKKYIKDN |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | APFVVQIYKKNDVLQTLMNDFQILPIGGVYELHAGDNIYLKFNSKDHIQKTNT<br>YWGIILMPDLPFIS (SEQ ID NO: 124) |
| Human<br>CD40L<br>(CD154) | >NM_000074.3 *Homo sapiens* CD40 ligand (CD40LG), mRNA<br>AATCCTGAGTAAGGTGGCCACTTTGACAGTCTTCTCATGCTGCCTCTGCCACC<br>TTCTCTGCCAGAAGATACCATTTCAACTTTAACACAGCATGATCGAAACATAC<br>AACCAAACTTCTCCCCGATCTGCGGCCACTGGACTGCCCATCAGCATGAAAAT<br>TTTTATGTATTTACTTACTGTTTTCTTATCACCCAGATGATTGGGTCAGCAC<br>TTTTTGCTGTGTATCTTCATAGAAGGTTGGACAAGATAGAAGATGAAAGGAAT<br>CTTCATGAAGATTTTGTATTCATGAAAACGATACAGAGATGCAACACAGGAGA<br>AAGATCCTTATCCTTACTGAACTGTGAGGAGATTAAAAGCCAGTTTGAAGGCT<br>TTGTGAAGGATATAATGTTAAACAAAGAGGAGACGAAGAAAGAAAACAGCTTT<br>GAAATGCAAAAAGGTGATCAGAATCCTCAAATTGCGGCACATGTCATAAGTGA<br>GGCCAGCAGTAAAACAACATCTGTGTTACAGTGGGCTGAAAAAGGATACTACA<br>CCATGAGCAACAACTTGGTAACCCTGGAAAATGGGAAACAGCTGACCGTTAAA<br>AGACAAGGACTCTATTATATCTATGCCCAAGTCACCTTCTGTTCCAATCGGGA<br>AGCTTCGAGTCAAGCTCCATTTATAGCCAGCCTCTGCCTAAAGTCCCCCGGTA<br>GATTCGAGAGAATCTTACTCAGAGCTGCAAATACCCACAGTTCCGCCAAACCT<br>TGCGGGCAACAATCCATTCACTTGGGAGGAGTATTTGAATTGCAACCAGGTGC<br>TTCGGTGTTTGTCAATGTGACTGATCCAAGCCAAGTGAGCCATGGCACTGGCT<br>TCACGTCCTTTGGCTTACTCAAACTCTGAACAGTGTCACCTTGCAGGCTGTGG<br>TGGAGCTGACGCTGGGAGTCTTCATAATACAGCACAGCGGTTAAGCCCACCCC<br>CTGTTAACTGCCTATTTATAACCCTAGGATCCTCCTTATGGAGAACTATTTAT<br>TATACACTCCAAGGCATGTAGAACTGTAATAAGTGAATTACAGGTCACATGAA<br>ACCAAAACGGGCCCTGCTCCATAAGAGCTTATATATCTGAAGCAGCAACCCCA<br>CTGATGCAGACATCCAGAGAGTCCTATGAAAAGACAAGGCCATTATGCACAGG<br>TTGAATTCTGAGTAAACAGCAGATAACTTGCCAAGTTCAGTTTTGTTTCTTTG<br>CGTGCAGTGTCTTTCCATGGATAATGCATTTGATTTATCAGTGAAGATGCAGA<br>AGGGAAATGGGGAGCCTCAGCTCACATTCAGTTATGGTTGACTCTGGGTTCCT<br>ATGGCCTTGTTGGAGGGGGCCAGGCTCTAGAACGTCTAACACAGTGGAGAACC<br>GAAACCCCCCCCCCCCCCGCCACCCTCTCGGACAGTTATTCATTCTCTTTC<br>AATCTCTCTCTCTCCATCTCTCTCTTTCAGTCTCTCTCTCAACCTCTTTCT<br>TCCAATCTCTCTTTCTCAATCTCTCTGTTTCCCTTTGTCAGTCTCTTCCCTCC<br>CCCAGTCTCTCTTCTCAATCCCCCTTTCTAACACACACACACACACACACACA<br>CACACACACACACACACACACACACACAGAGTCAGGCCGTTGCTAGTCAGT<br>TCTCTTCTTTCCACCCTGTCCCTATCTCTACCACTATAGATGAGGGTGAGGAG<br>TAGGGAGTGCAGCCCTGAGCCTGCCCACTCCTCATTACGAAATGACTGTATTT<br>AAAGGAAATCTATTGTATCTACCTGCAGTCTCCATTGTTTCCAGAGTGAACTT<br>GTAATTATCTTGTTATTTATTTTTGAATAATAAAGACCTCTTAACATTA<br>(SEQ ID NO: 125) |
| | >NP_000065.1 C040 ligand [*Homo sapiens*]<br>MIETYNQTSPRSAATGLPISMKIFMYLLTVFLITQMIGSALFAVYLHRRLDKI<br>EDERNLHEDFVFMKTIQRCNTGERSLSLLNCEEIKSQFEGFVKDIMLNKEETK<br>KENSFEMQKGDQNPQIAAHVISEASSKTTSVLQWAEKGYYTMSNNLVTLENGK<br>QLTVKRQGLYYIYAQVTFCSNREASSQAPFIASLCLKSPGRFERILLRAANTH<br>SSAKPCGQQSIHLGGVFELQPGASVFVNVTDPSQVSHGTGFTSFGLLKL<br>(SEQ ID NO: 126) |
| Mouse CD40L | >NM_011616.2 *Mus musculus* CD40 ligand (Cd40lg), mRNA<br>CTTTCAGTCAGCATGATAGAAACATACAGCCAACCTTCCCCCAGATCCGTGGC<br>AACTGGACTTCCAGCGAGCATGAAGATTTTTATGTATTTACTTACTGTTTTCC<br>TTATCACCCAAATGATTGGATCTGTGCTTTTTGCTGTGTATCTTCATAGAAGA<br>TTGGATAAGGTCGAAGAGGAAGTAAACCTTCATGAAGATTTTGTATTCATAAA<br>AAAGCTAAAGAGATGCAACAAAGGAGAAGGATCTTTATCCTTGCTGAACTGTG<br>AGGAGATGAGAAGGCAATTTGAAGACCTTGTCAAGGATATAACGTTAAACAAA<br>GAAGAGAAAAAAGAAAACAGCTTTGAAATGCAAAGAGGTGATGAGGATCCTCA<br>AATTGCAGCACACGTTGTAAGCGAAGCCAACAGTAATGCAGCATCCGTTCTAC<br>AGTGGGCCAAGAAAGGATATTATACCATGAAAAGCAACTTGGTAATGCTTGAA<br>AATGGGAAACAGCTGACGGTTAAAAGAGAAGGACTCTATTATGTCTACACTCA<br>AGTCACCTTCTGCTCTAATCGGAGCCTTCGAGTCAACGCCCATTCATCGTCG<br>GCCTCTGGCTGAAGCCCAGCAGTGGATCTGAGAGAATCTTACTCAAGGCGGCA<br>AATACCCACAGTTCCTCCCAGCTTTGCGAGCAGCAGTCTGTTCACTTGGGCGG<br>AGTGTTTGAATTACAAGCTGGTGCTTCTGTGTTTGTCAACGTGACTGAAGCAA<br>GCCAAGTGATCCACAGAGTTGGCTTCTCATCTTTTGGCTTACTCAAACTCTGA<br>ACAGTGCGCTGTCCTAGGCTGCAGCAGGGCTGATGCTGGCAGTCTTCCCTATA<br>CAGCAAGTCAGTTAGGACCTGCCCTGTGTTGAACTGCCTATTTATAACCCTAG<br>GATCCTCCTCATGGAGAACTATTTATTATGTACCCCAAGGCACATAGAGCTG<br>GAATAAGAGAATTACAGGGCAGGCAAAAATCCCAAGGGACCCTGCTCCCTAAG<br>AACTTACAATCTGAAACAGCAACCCCCACTGATTCAGACAACCAGAAAAGACAA<br>AGCCATAATACACAGATGACAGAGCTCTGATGAAACAACAGATAACTAATGAG<br>CACAGTTTTGTTGTTTTATGGGTGTGTCGTTCAATGACAGTGTACTTGACTT<br>ACCAGGGAAGATGCAGAAGGGCAACTGTGAGCCTCAGCTCACAATCTGTTATG<br>GTTGACCTGGGCTCCCTGCGGCCCTAGTAGG (SEQ ID NO: 127) |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | >NP_035746.2 CD40 ligand [Mus musculus]<br>MIETYSQPSPRSVATGLPASMKIFMYLLTVFLITQMIGSVLFAVYLHRRLDKV<br>EEEVNLHEDFVFIKKLKRCNKGEGSLSLLNCEEMRRQFEDLVKDITLNKEEKK<br>ENSFEMQRGDEDPQIAAHVVSEANSNAASVLQWAKKGYYTMKSNLVMLENGKQ<br>LTVKREGLYYVYTQVTFCSNREPSSQRPFIVGLWLKPSSGSERILLKAANTHS<br>SSQLCEQQSVHLGGVFELQAGASVFVNVTEASQVIHRVGFSSFGLLKL (SEQ<br>ID NO: 128) |
| Human LIGHT (CD258) | >NM_003807.5 Homo sapiens TNF superfamily member 14 (TNFSF14), transcript variant 1, mRNA<br>CGAGACTCCATCTCAAAAACAAAACAAATAAACGAACAAAAAAACCCACAACG<br>TATTATTTTCTTGTTTACGAGGTTTCTTGTCTCTCTGGCTCCACCAGAAGAGG<br>AGCAGGGACCCTTCTTGCTGTTGTTCATTGCTGCATCCCCCACACCGAGAGCA<br>GAGCCTGGCATGGGCAGAAAGTCCTCAGTCGATATTTGGTGGCCCCAAGCGAA<br>TGAAGCATCCAAGAAGGGAAAGCTGGGGGCTCCCCACTGCACTTGCCACCTGA<br>GTCACATTTTCAGAAGCCTCTGGAAAGTCGTGCACAGCCCAGGAGTGTTGAGC<br>AATTTCGGTTTCCTCTGAGGTTGAAGGACCCAGGCGTGTCAGCCCTGCTCCAG<br>ACACCTTGGGCATGGAGGAGAGTGTCGTACGGCCCTCAGTGTTTGTGGTGGAT<br>GGACAGACCGACATCCCATTCACGAGGCTGGGACGAAGCCACCGGAGACAGTC<br>GTGCAGTGTGGCCCGGGTGGGTCTGGGTCTCTTGCTGTTGCTGATGGGGGCCG<br>GGCTGGCCGTCCAAGGCTGGTTCCTCCTGCAGCTGCACTGGCGTCTAGGAGAG<br>ATGGTCACCCGCCTGCCTGACGGACCTGCAGGCTCCTGGGAGCAGCTGATACA<br>AGAGCGAAGGTCTCACGAGGTCAACCCAGCAGCGCATCTCACAGGGGCCAACT<br>CCAGCTTGACCGGCAGCGGGGGGCCGCTGTTATGGGAGACTCAGCTGGGCCTG<br>GCCTTCCTGAGGGGCCTCAGCTACCACGATGGGGCCCTTGTGGTCACCAAAGC<br>TGGCTACTACTACATCTACTCCAAGGTGCAGCTGGGCGGTGTGGGCTGCCCGC<br>TGGGCCTGGCCAGCACCATCACCCACGGCCTCTACAAGCGCACACCCCGCTAC<br>CCCGAGGAGCTGGAGCTGTTGGTCAGCCAGCAGTCACCCTGCGGACGGGCCAC<br>CAGCAGCTCCCGGGTCTGGTGGGACAGCAGCTTCCTGGGTGGTGTGGTACACC<br>TGGAGGCTGGGGAGAAGGTGGTCGTCCGTGTGCTGGATGAACGCCTGGTTCGA<br>CTGCGTGATGGTACCCGGTCTTACTTCGGGGCTTTCATGGTGTGAAGGAAGGA<br>GCGTGGTGCATTGGACATGGGTCTGACACGTGGAGAACTCAGAGGGTGCCTCA<br>GGGGAAAGAAAACTCACGAAGCAGAGGCTGGGCGTGGTGGCTCTCGCCTGTAA<br>TCCCAGCACTTTGGGAGGCCAAGGCAGGCGGATCACCTGAGGTCAGGAGTTCG<br>AGACCAGCCTGGCTAACATGGCAAACCCCATCTCTACTAAAAATACAAAAAT<br>TAGCCGGACGTGGTGGTGCCTGCCTGTAATCCAGCTACTCAGGAGGCTGAGGC<br>AGGATAATTTTGCTTAAACCCGGGAGGCGGAGGTTGCAGTGAGCCGAGATCAC<br>ACCACTGCACTCCAACCTGGGAAACGCAGTGAGACTGTGCCTCAAAAAAAAGA<br>AAGGAAGAAAAAGAAAACTCAGGAAACAGATCTTGGGGGACACTCCAGGGAA<br>CCCAAAACTCAAAGGCGGAGAGCTCAGTGGGCACCACCAAGGCGAGATGAAGC<br>CCCAGCAGGCACCTTCAGAAGACCCACGTAGACTGCAGACCCTGCCACGGACA<br>ATACTAAGGACAAAAACCCAGAGACTTGGGGTCTGTGGGCCCCCAAACATGGG<br>GTAAAGTTGATTTGCCTGATATTCAGGAAGAAGGGGTGAGGGGTGGGTATTTA<br>TGCTTTTGATTCAGAAGAAAGTGGGGCTTGGGATTCCAGGGACTTGGCTGGGG<br>GTGGGAAACTTCATCCACTTCCCTACTCTCATCATGAGTACGGACAGGGTGGG<br>CGGGAGACTGATCATCGGGACTCATCATGAAGAGCCCAGCCCCACCCCACATA<br>CTCAGATCCCACCCACAGACTGGTGGCCACACCTCAGCCTGGTCACAAAGAGT<br>TACACTCAGATACATGAGCACGGCAGCGTGCTCATAACTGTTTAACAACCAGC<br>TGTCCTGGGAGGGGGACAGCTTTGTAATGTTTGCCAATTTCCATGGTGTAAAT<br>GCTACCACCATGGCTGATTTCATCACTGCCAAGCATAGACATCCCTAATAGGA<br>CACCACGGATCTGTCCCCGGCATCCGGCCCAGGGCCTGGCACAAAGCATGCTC<br>TAGGGAAATGCTTGCTGATTGAAAGGAAGGAAGAATGACTCTACAGTCACACC<br>TATGGCATCCCACAAAATCTGTCACATGGCTGCATAATCTCAGCCACTCTTTC<br>ACAACTATAGACTCATACACGCGAAGTGCCAGATTCATGCACAACCACACAAT<br>CACATGGAAGTCACAGACGGCATCACAGACAGTCACAGCACTGTGTGTATGTT<br>ATAACACAAGCACACAAAACTCAGACAGCATCCCAGCTACACAGCCACTCCCA<br>GAGGTGTCACCGTCACACTTGGTAATTAATACTCATTACATTAGACACAGACA<br>GACCAAGTTATAGTCAGACCTGGTTACACACATACACACACAATATCACCA<br>TGACAAATACACATTACACACACACAACATCACAATGACAAACACACATTACA<br>CACACAACATCACGATGACAAACACACATTACACACACAACATCACGATGACA<br>AACACACATTACACACACATCACAATGACAAACACAACATTACACACACACAA<br>CATCACAATGACACACACATCACACACACATCACAATGACAAACACAACAT<br>TACACACATATACACACAGCCTGAGGGCCCTCCCCAGCCCAGACTAACACATC<br>TCGGGGTGAGGACCAGACCTTGTTCATAACCCTGGGCCTCTTAACCACTGATC<br>TTTGAAATAAATGGCAAATAGTTGTACCTGGATCTGTCTAGTTCTTAGGGGAA<br>CAAACTGAAGAGGGTGGAGAGGAATTGTCAGGCCTAAAGAGCCCCACAGGGA<br>AAGGGAGGAGTCGGATGGGGGGCAACCATCAGCAACAAGTGGTGGCTCCTAGA<br>GGCAGAGGGATGGAGGTAATGACCCATGGAGGTCATTCTACAGATGAGGAACC<br>TGGACCCAGTTGGCTCAAGTCCATGCAGGAAATGTGGGGGAAACCAGAGACCT<br>CACGTCTGGATCTGGCTTCCTCTCCAATCCACAATTCCTGAGGAAGTAGAGGC<br>TACATCCCGCAAGACGCCCTTATTAGACACATCCAGGACAGAATGACAATCCG<br>CCAAGCCAGCTGGAAGCATAAAACACAGGGAGCTGGTGGGTTGGGTGGGGGCA<br>GATAATGATATGCATACAAATTAGAGGGTCTATGCAAATGAGCATTGCTGCAG<br>TGTGGCTGGAGGGAATCCTTAGTTCCTAGGATTCTAGGATATGGGTTTCGACC<br>CCAGAGGTGAATGTATTGTTATTATTGTTTTGTTGTTGTTGTGAATGACAAGT |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | CAAAATTTGTGGGTTATTGTTGTTATCGCCAATAGTATTCTTGTCATTGTTGC<br>ACAGTACAGAGATGAAGGAAACAGATTTTGCAATCAGATGATCCTGGGTTCTG<br>AGTCCACTCTGCCACTCACCAGCTATATGACCTCCAGCAATTTCCATCACCTC<br>TCAATGCTTCAGTTTCCCCATCGGCAAGATGGTTGTGGGGGGAGAGGAACAAC<br>AGTACAGATTCACCATCCCAAATTCAAATGCTCCAAAATCTAGGCCGGGCGT<br>GGTGGCTCATACCTGTAATCCCAGCACTTTGGGAGGTCAAAGTGGACGGATAA<br>CCTGAGGTCAGGAGCTCCAGACCAGCCTGGCCAACATGGCGAAACCCCATCTC<br>TACTAAAAATACAAAAAATTACCTGGGTGTGGTGGGGGGCACCTGTAACCCCA<br>GCTACTCGGGAGGCTGAGGCAGGAACCCTGGAGGTTGAGGTTGCAGTGAGCTG<br>AGATCACACCACTGCACTCCAGCCTGGGTGACAGAGCAAGGCTCCCATCTCAA<br>AAAACAAAAAAACATGCTCCAAAATCTGAAACTCTTTGAGCCCCAGTGTGATG<br>CCACAAGTGGGAAATTCCACAACTCATCACATGTGATAGATTGCAGTGGAAAT<br>GCAGGCACACACCACGAAGTTTACTCAGCATCCTCAAAGGAAATCCCCGTCAG<br>TAGCTATATATCATTTTCTCACATGCCAGATAGGTATCTCTCATCTTTTACTG<br>TTAGGTACTTCTGTGTTGAATAGGTGGAGGAAAATGATTGCTGGTTAGTAGTA<br>TATAAATTCAGAGTCAGGAAGGATGGTGATGTCGGCTGGGTGCAGTGGCTCAT<br>GCCTGTAATTCCAATGTGATACCCTACCTTGTGTTTAACGTGATTGACTCTCC<br>CTTAGCTGAGAGGGCCAGGCAGACTCTATTTTGGCTTCTTCGCTTGCAGTCTC<br>TCACCCACCCCCCTTCCTCAAGGACTTAAGCTGACTCCCAGCACATCCAAGAA<br>TGCGATTACTGATAAGATACTGTGACAAGCTATATCCACAATTCCCAGGAATT<br>CGTCCGGTTGATAGCACCCAAAGCCCCCGCGTCTATCACCTTGTGATAGATTT<br>AAAGCCCCTGCACCTGGAACTGTTTGTTTTTCTGTTACCATTTATCTTTTTCA<br>CTTTCTTGCCTGTTTTGCTTCTGTAAAATTGCTTCAGCTCGGCTCCCTCTTCC<br>CCTTCTAAACCAAGGTATAAAAAGAAACCTAGCCCCTTCTTTGGGGTGGAGAG<br>AATTTTGAGCGCTAGCCGTCTCTCAGTCGCCGGCTAATAAAGGACTCCTGAAT<br>TAGTCTAA (SEQ ID NO: 129)<br><br>>NP_003798.2 tumor necrosis factor ligand superfamily<br>member 14 isoform 1 [Homo sapiens]<br>MEESVVRPSVFVVDGQTDIPFTRLGRSHRRQSCSVARVGLGLLLLLMGAGLAV<br>QGWFLLQLHWRLGEMVTRLPDGPAGSWEQLIQERRSHEVNPAAHLTGANSSLT<br>GSGGPLLWETQLGLAFLRGLSYHDGALVVTKAGYYYIYSKVQLGGVGCPLGLA<br>STITHGLYKRTPRYPEELELLVSQQSPCGRATSSSRVWWDSSFLGGVVHLEAG<br>EKVVVRVLDERLVRLRDGTRSYFGAFMV (SEQ ID NO: 130) |
| Mouse LIGHT | >NM_019418.3 Mus musculus tumor necrosis factor<br>(ligand) superfamily, member 14 (Tnfsf14), mRNA<br>TTTTGCAGTTTGCACAGCCCGAGCGTGTTGGGCAATTGTGGTTTCCTCCGGAG<br>AGGAGGAACTCAGGCTTGCCAACCCTTTCCCTGGGCTTCGGAGCCTCAGCTGC<br>TCTGGCATGGAGAGTGTGGTACAGCCTTCAGTGTTTGTGGTGGATGGACAGAC<br>GGACATCCCATTCAGGCGGCTGGAACAGAACCACCGGAGACGGCGCTGTGGCA<br>CTGTCCAGGTCAGCCTGGCCCTGGTGCTGCTGCTAGGTGCTGGGCTGGCCACT<br>CAGGGCTGGTTTCTCCTGAGACTGCATCAACGTCTTGGAGACATAGTAGCTCA<br>TCTGCCAGATGGAGGCAAAGGCTCCTGGGAGAAGCTGATACAAGATCAACGAT<br>CTCACCAGGCCAACCCAGCAGCACATCTTACAGGAGCCAACGCCAGCTTGATA<br>GGTATTGGTGGACCTCTGTTATGGGAGACACGACTTGGCCTGGCCTTCTTGAG<br>GGGCTTGACGTATCATGATGGGGCCCTGGTGACCATGGAGCCCGGTTACTACT<br>ATGTGTACTCCAAAGTGCAGCTGAGCGGCGTGGGCTGCCCCCAGGGGCTGGCC<br>AATGGCCTCCCCATCACCCATGGACTATACAAGCGCACATCCCGCTACCCGAA<br>GGAGTTAGAACTGCTGGTCAGTCGGCGGTCACCCTGTGGCCGGGCCAACAGCT<br>CCCGAGTCTGGTGGGACAGCAGCTTCCTGGGCGGCGTGGTACATCTGGAGGCT<br>GGGGAAGAGGTGGTGGTCCGCGTGCCTGGAAACCGCCTGGTCAGACCACGTGA<br>CGGCACCAGGTCCTATTTCGGAGCTTTCATGGTCTGAAGGCTGCGGTGACAAT<br>GTATTTTGTGGAGGGACCTCTCCAGGACTCACCTCAAACCCAGCAATAGGGTT<br>TGAAGTCCTCCCTTTAAGGAGCCCTGAACTCTGCAGTGCTCGGGGCGGTGTAG<br>ACTGGTGACCTGCTTTGGGCAATCTTCAAATCAGAGACCTGGAGACTTGGGGC<br>GTGGAGCCCAGGAGCGAGGGGTCAGCTCATTTGCCTGATATTCAGGAAGAAAG<br>AATCAAGCTGGGGTATTTATGCTTCTGATGCAAACACTGAGATTCGGCTTTC<br>TGGGTTTTGAGCTGGAGGCAAGAAACCTTCCCAGAGTGTCATCAGGACCATGT<br>TGGCAGGACTTGGGGCTCCAGACTTGCCACCACACTCTGGCCTCTCCCATCCA<br>TCCGCTGCATTGGTTTCCAGCCACCAAAACAGCACTGGCCCCCTGGCTGCAAC<br>TGGCCAGGTACGAGCTTCTGAGCACCTACATTCCTCAGGGACATCTTGATGAG<br>ATCTCAGTACTCAGTCCAATGCGCAGCAGCGACAGACATGCCAGGAATGGTTG<br>GTCAGAAGGGAAGGGAGGAAAGGGAGGAAAGAAGGGAATGCAGAAGAGAAGGG<br>GGGAAAACAAGACCAAAACAAAACAGCAACAACAAAGCGGCAGGGAGGAGGTG<br>ACACCCTTGGGGATACTTTAGTCAACACACTTAGAACAGATTGTGCCAGGCCT<br>GTTGGATTCCTGGAGTTGATGGGATCGTGGGAAGGCACAATGGGGAGCAAGTG<br>GGCTTGGGTTATGGCTCAGTGGGTAAAGTGCAATTATGGGGATCTGAGTTTGA<br>ATCCCTGGTACCCATATAAGACACAGATGCGGTGATGGGCACTTGTGACAAT<br>GAGATCATCAATAGGGAATGGAGACAGGAGGGACCTCTGGGGTTCACTGGCCA<br>GGCAGTCTAGCTGAATCAAAGAGCTCCAAGTTCAGTCGATAGCTCCTGAAGAT<br>GACAACTGAGGCTATTCTCCAAACCCCACACGCAGGACACATGCGTAATAAAT<br>AAAATTTTAAAAAT (SEQ ID NO: 131) |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | >NP_062291.1 tumor necrosis factor ligand superfamily member 14 [Mus musculus]<br>MESVVQPSVFVVDGQTDIPFRRLEQNHRRRRCGTVQVSLALVLLLGAGLATQG<br>WFLLRLHQRLGDIVAHLPDGGKGSWEKLIQDQRSHQANPAAHLTGANASLIGI<br>GGPLLWETRLGLAFLRGLTYHDGALVTMEPGYYVYSKVQLSGVGCPQGLANG<br>LPITHGLYKRTSRYPKELELLVSRRSPCGRANSSRVWWDSSFLGGVVHLEAGE<br>EVVVRVPGNRLVRPRDGTRSYFGAFMV (SEQ ID NO: 132) |
| Human TL1 | >NM_005118.4 Homo sapiens TNF superfamily member 15 (TNFSF15), transcript variant 1, mRNA<br>AGAGGTGCCTCCAGGAGCAGCAGGAGCATGGCCGAGGATCTGGGACTGAGCTT<br>TGGGGAAACAGCCAGTGTGGAAATGCTGCCAGAGCACGGCAGCTGCAGGCCCA<br>AGGCCAGGAGCAGCAGCGCACGCTGGGCTCTCACCTGCTGCCTGGTGTTGCTC<br>CCCTTCCTTGCAGGACTCACCACATACCTGCTTGTCAGCCAGCTCCGGGCCCA<br>GGGAGAGGCCTGTGTGCAGTTCCAGGCTCTAAAAGGACGGGAGTTTGCACCTT<br>CACATCAGCAAGTTTATGCACCTCTTAGAGCAGACGGAGATAAGCCAAGGGCA<br>CACCTGACAGTTGTGAGACAAACTCCCACACAGCACTTTAAAAATCAGTTCCC<br>AGCTCTGCACTGGGAACATGAACTAGGCCTGGCCTTCACCAAGAACCGAATGA<br>ACTATACCAACAAATTCCTGCTGATCCCAGAGTCGGGAGACTACTTCATTTAC<br>TCCCAGGTCACATTCCGTGGGATGACCTCTGAGTGCAGTGAAATCAGACAAGC<br>AGGCCGACCAAACAAGCCAGACTCCATCACTGTGGTCATCACCAAGGTAACAG<br>ACAGCTACCCTGAGCCAACCCAGCTCCTCATGGGGACCAAGTCTGTATGCGAA<br>GTAGGTAGCAACTGGTTCCAGCCCATCTACCTCGGAGCCATGTTCTCCTTGCA<br>AGAAGGGGACAAGCTAATGGTGAACGTCAGTGACATCTCTTTGGTGGATTACA<br>CAAAAGAAGATAAAACCTTCTTTGGAGCCTTCTTACTATAGGAGGAGAGCAAA<br>TATCATTATATGAAAGTCCTCTGCCACCGAGTTCCTAATTTTCTTTGTTCAAA<br>TGTAATTATAACCAGGGGTTTTCTTGGGGCCGGGAGTAGGGGGCATTCCACAG<br>GGACAACGGTTTAGCTATGAAATTTGGGGCCCAAAATTTCACACTTCATGTGC<br>CTTACTGATGAGAGTACTAACTGGAAAAAGGCTGAAGAGAGCAAATATATTAT<br>TAAGATGGGTTGGAGGATTGGCGAGTTTCTAAATATTAAGACACTGATCACTA<br>AATGAATGGATGATCTACTCGGGTCAGGATTGAAAGAGAAATATTTCAACACC<br>TTCCTGCTATACAATGGTCACCAGTGGTCCAGTTATTGTTCAATTTGATCATA<br>AATTTGCTTCAATTCAGGAGCTTTGAAGGAAGTCCAAGGAAAGCTCTAGAAAA<br>CAGTATAAACTTTCAGAGGCAAAATCCTTCACCAATTTTTCCACATACTTTCA<br>TGCCTTGCCTAAAAAAAATGAAAAGAGAGTTGGTATGTCTCATGAATGTTCAC<br>ACAGAAGGAGTTGGTTTTCATGTCATCTACAGCATATGAGAAAAGCTACCTTT<br>CTTTTGATTATGTACACAGATATCTAAATAAGGAAGTATGAGTTTCACATGTA<br>TATCAAAAATACAACAGTTGCTTGTATTCAGTAGAGTTTTCTTGCCCACCTAT<br>TTTGTGCTGGGTTCTACCTTAACCCAGAAGACACTATGAAAAACAAGACAGAC<br>TCCACTCAAAATTTATATGAACACCACTAGATACTTCCTGATCAAACATCAGT<br>CAACATACTCTAAAGAATAACTCCAAGTCTTGGCCAGGCGCAGTGGCTCACAC<br>CTGTAATCCCAACACTTTGGGAGGCCAAGGTGGGTGGATCATCTAAGGCCGGG<br>AGTTCAAGACCAGCCTGACCAACGTGGAGAAACCCCATCTCTACTAAAAATAC<br>AAAATTAGCCGGGCGTGGTAGCGCATGGCTGTAATCCTGGCTACTCAGGAGGC<br>CGAGGCAGAAGAATTGCTTGAACTGGGGAGGCAGAGGTTGCGGTGAGCCCAGA<br>TCGCGCCATTGCACTCCAGCCTGGGTAACAAGAGCAAACTCTGTCCAAAAAA<br>AAAAAAATAAAATAATAACTCCAAGCCTTTAAAAAATATCATCTGAAACTGTT<br>ACATCAGATTTCTGGCACTCTACTGACTGTGGAAGATAGCCAGCTGACTGGAA<br>GATAGCCAGCTGATTAGTTCCCTGAAGAAACCTGAAGACAGATACCTGGTTAA<br>CTAGATCAACTACACTGCCAACTTGTTTGATGCTGAGAGACAATGGACTTATT<br>CCATGGGGGAAGGGAAAAAAGAAGTCAATCACCAAATCTGAAGAAGTTAACCT<br>AGATCTTTGAGGTTTGATTTGCAACTTTATATGCAGAGTATTATGTGGGTATT<br>TTCCCTTAAAATATTCAAAGGGATTTACATATGGGATTAGCTAATGAGCCTAG<br>CCAAGACCTTCCCTGGAGGACAGGCTGGTCATTGCGGAGGTCCCTTCTGTGCT<br>TCAGTGGGTTCATATCCTCTAGTCCGTATGATTTTCCTACGCTAATATGTCAA<br>GGGCAGGAGAGGCAGCTCTGTTCTCCTAGCCTTTGTTGACTTGTCTGCAAAGC<br>AGGAATCTGCCCATTTGTTTCCAAGGAGCAAATGAGCTCATGAGAATGAAAGA<br>TGTTAACTTCATGCATTCTGTGCCATCTGAGCATTTCGGTATTATATGACTGG<br>TGACCCTTGGCCCGTATTATAAATGCTTCCTATCCTGGGAGACCTCATGGATG<br>AGTCTGAGAGGAAATTTGGCACCAAAATCACTCTCACTCTGGTTTCCAGTAGA<br>CTATAGAGGCAGAGAGGCATTTGAGAGGCTCCTGAGCAAAGTGTCCAGTGTAG<br>CAGGAGCACTTCATTAATATTTATTGAGTTATAATTAAATAAAAATTAATTTC<br>TGATTTCTCAGTTTGGAGGTTAAGGCTCTAAATATATTTTCTAACCTCTGCTA<br>GGCTAACTTAAGCCAGGCCTTTTTCTTGCCTTCCCTTTCTCAAAACAGTCAGC<br>ACAGACTCAGTGGGAGCACAGAGGAGTGTGGTCACCTCCACCTGGCTCACCAG<br>AGTCTTCATAGAGGAAGTGAAGCCTGGAAGAAACTGGGCGGGCCCCAGATGAC<br>CACAGGGAAGGGCATCTCAGATGGAGGAATTACCCTTGACTTAAAGCAGAAA<br>AGAAAGATTTCTCAGTAACTCCAAAACTTGCTTGATAGGAGAATATTCCCTCA<br>ACCAATTCCTAGGACAATATTTATTGGTAGATCAAGAATGTTTCCTCAATAAC<br>TCTAGTCTAGCTCCATGATCAGAACTAACACCCATTAAAAACATAAAATGTTC<br>TTTCTGAACCGGTCTTCATGGTGCGTGAGAGCACCAAGCAGCTTTGGTATGCA<br>GGAGGAGTTTTGCACAGAAGAGTGGCCTGCTCAAACCTGCCCACTGTTCTGTA<br>GGTGATCTGGTGGATCTGGAAATTTATCCCAAGACAGGAATTTCCTAATATTC<br>GAAGACATTTGAGGCTTTGGGAAATTTCTCTGCTGTGCATTTATTTGGCTCCTG</td>

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | TCATAAGCTTGTTTTTAAAGAATGTATCATAGCTCAAGTTTTTACTGCTGAT<br>TTTGTTAAATTCTGTATAGTATATTTTTTACGGAAAGGCACAGTCAGACATTC<br>CTAATAGGGCTCATGTCAGAACTTCTGTTCCCAAGGCATTATCTCCATAGCAA<br>AAATTAGTGCACTGTTTTCAAAAGTGAGGTGGGAAAATGCTTTTAAGATCATG<br>TGATGTTCCCCTAAAAGGGGTTAATGGGGTGTATTCAGGGTTTGGGAGGGAGG<br>AAGAAGCATGCTTTAGAAAACAGTAAATTTAGGGAGAAAATGCTTTGTTGGTT<br>AAATGTCACTCAAAAGGCTGAATTCAAATCAATTCCACAAACATTTACTGAGT<br>ACCTACTGCCCCTGGGGACACAGAGATAAATTATTTAGTCTCAGACACACTCA<br>TTCTAACTTCCCAGCACCTCTACTGTCTGCAGATTCTTTAATTTATTTTGGTT<br>GTATTAGCTAATTAATTCGTAAACTTTAGGCACATGGATCTATTCTCATTATG<br>AAAATGGATGCCATTTGATTAAGGCTGATGACTAACAAAATGATTTGTGTTTA<br>CTCGAAGTGTTTTTTAAAAATAGCTACTCAAGGATAGTTTTCCATAAATCAA<br>GAAGGTAAAAAAGTTCCCATTTTTTATTGTAGAATCCATTATTTAAACTACAT<br>GTAGAGACAGGTTATTATTTGCTATATTCAAGTTTGGTCATCAATACCCTTAA<br>AAATATTAGAATTTTATGGATGACCCAGAAATGCTTTGAAAATCTGTGTTCCT<br>CAGCAAATACAGAGACCATGATCAAAATGCACAGAATCACTAACATTTTGATG<br>CTAGCATGGTTTCAGTCTATTTGGCAGAACAGAATTGATTATGCTACTAAAAT<br>TTCTTTTTCTTTTTTTTTTTTTTTTTTGAGACAGAGTCTTGCTTTGTCAC<br>CCAGGCTGAAGTGCAGTGGCAGGATCTCAGTTCACTGCAACCTCTGCCTCCCA<br>GGTTCACGCCATTCTCCTGCTTCAGCCTCCCGAGTAGCTGGGACTACAGGCTC<br>CCACCACCATGCCCGGCTAATTTTTTGCATTTTTAGTAGAGACGGGGTTTCAC<br>CGTGTTAGCCAGGATGGTCTCGATCTCCTGACCTCGTGATCCGCCCGCCTCAG<br>CCTTCCAAAGTGCTGGGATTACAGGCGTGAGCCACTGTGCCCGGACTCTGATT<br>TTTTTTTTACTAAGGTACAGTAAGAAAAGGGAAAAGTGTACGTTTTCACTTCC<br>TGAAATATGTCAGGTTGAATCAATAATAGAGCACACCAGAACTCTTGGCTCCA<br>TTTCAACCTAAACTATTCAGTTCTCATCACCCCAGAGGAAATTCCGCCTCTGT<br>GCTGGTCAGTAATCCCCCTGGATTATAAAAGTTTAACTAACTCACTGTGCACA<br>AGGCACGGCCATTGCCAACATTCTCTTGCAAGGTATTTTCCCAAGCCCTTACC<br>CAATTCTGTTTCCATGATTGTGACATTGGGGATTAATTCTGCAAGACAGAACT<br>GTTTATATTCTGTACCTTAAAAACACATGCAAACATCTCTTGCCTTAAGATTT<br>CTGGCTTTCCTATGGCCCAGAGTCCTAGAAGTGTTTTGATATTTGTAGCAGAA<br>TTTTCAAGTGTACATCCTTATCCTGGATATTAACATTTTTGCATCATATTGGC<br>AGCTGGACCTACAGAGAATTTAGTAGACTGTTAACCTAATAAGCCTTGAATCC<br>TTTTGCACCAGTGGTGAGAGAATGTGGATCAGAGCCATCACCTCCATGCCCCG<br>TCACCCTCTAACAACCACATTTACAACTTCCCCAGCTCTGAGACACACTTGCC<br>TCCACCCCTTCCATCACCCCATTTTAAGATGAAAATACCACACCAGCCTGGAA<br>GGAAGAAGTTACTTGCCCAGGGCCACATAGTGAGTTAAGGGCTGATCTAGAGC<br>TAGGAAGCTGTCTTCCTGAACCATAATCCTGGACTCTTCTAACCTCTCTACTC<br>ATCGCAAATAGAGTTCATTTTAGTGATTTGAAGGAAGATGGGACAAGTATTTT<br>CAAACACCTGTAGGACAACATGGAAGTGGGAGGAGACTTCTACTGTAGCTCCC<br>CAGAGAAGAGAGCTAGGGCTACAGAGTTGCAGTTACAAGGTTGCCCTCTCTGG<br>CTTGATCCCAAAGGAATTTTCTACTCCAAAATAGAATTTTTCTAGGATGCTA<br>TTTCTCAGTCCCTGGAGATACTCAAACAAAGGGCTTGTCACAAGGGTTTTTGT<br>AGAAGCTATTCTTCACAGAGGTTGGGGGAGAGATTAAGCCAAAGGATCTCTGA<br>GGTCTTTTTCAAATCTATAATTATGTGGCCTTTTGTTCATTGACTTCCATGTG<br>TTCTAGTTGATCATTACAAACCTGGCAGGCCTTCTCAAGGGTTCAGTAATTAG<br>CTGTCATTTCCCATTTGTCCAGAGAGTGTCCAACACAAAATACCCCTAAGATC<br>TTGGCCAATAGAGAAATGTCATGGAATTTTAGAAATGACAGTATCTGCGGAGT<br>TTATTCCAAGTTATATCATTTCAAAGATGAAGAAACCCAGGCTCAGAGGGAGC<br>CATCACATCCACACCCTGTCACCCTTCGTGGCCAGTGCCAGACAGTAGCTAGT<br>TGGATGCTAAAAGTAGAATTTAGATATCTTAACAATAAGCCCAGCAGTCTTTC<br>AACTTCATTCGTAAATCATTTTTGTTTTGAGCATCTGTCACGTGGCAGCACTT<br>GCCTGGATACTGGAGAGCTGAGAAGGAATGCGACAGGCAAGTCCTACTCTCAC<br>AGTGTATACATTCAGGAGGAACAAGACACACAGTGCCAAGTAAATAAAGTAGC<br>TGAACTTCATCAAATGATTTTATTCTTAAAGTCATTAAAGCATGTAATGTTCC<br>CCTTTTTTGTTTCAGGGGTGTACAGATTGAAGAAGTGTAGGTGTTTATGTGG<br>TTTTAGTGACAAACCCCATGTGCTTTCATTGATTTTATGTTTTATGTTAAAAC<br>ATCAACCGCAAGGTAAAATGCATATTGTATGTTGTTGGATACGTACTTAACTG<br>GTATGCATCCCATGTCTTTGGGTACTAGTGTATGAATTCTAATCTCTGTAAAT<br>GAAATGTTGTATGTGTTAATATATTTAATAGATGTAACTTAATAAACTGGCAT<br>TGAAGACTGAA (SEQ ID NO: 133)<br><br>>NP_005109.2 tumor necrosis factor ligand superfamily<br>member 15 isoform VEGI-251 precursor [Homo sapiens]<br>MAEDLGLSFGETASVEMLPEHGSCRPKARSSSARWALTCCLVLLPFLAGLTTY<br>LLVSQLRAQGEACVQFQALKGQEFAPSHQQVYAPLRADGDKPRAHLTVVRQTP<br>TQHFKNQFPALHWEHELGLAFTKNRMNYTNKFLLIPESGDYFIYSQVTFRGMT<br>SECSEIRQAGRPNKPDSITVVITKVTDSYPEPTQLLMGTKSVCEVGSNWFQPI<br>YLGAMFSLQEGDKLMVNVSDISLVDYTKEDKTFFGAFLL (SEQ ID NO: 134) |
| Mouse TL1 | >NM_177371.4 Mus musculus tumor necrosis factor<br>(ligand) superfamily, member 15 (Tnfsf15), mRNA<br>ATCAGAAGTCTCTCCAAGCACAGAGAAGGATGGCAGAGGAGCTGGGGTTGGGC<br>TTCGGAGAAGGAGTCCCAGTGGAAGTGCTGCCGGAAGGCTGTAGACACAGGCC |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | AGAGGCCAGGGCCGGGCTAGCTGCCAGGAGCAAAGCCTGCCTGGCTCTCACCT<br>GCTGCCTGTTGTCATTTCCCATCCTCGCAGGACTTAGCACCCTCCTAATGGCT<br>GGCCAGCTCCGGGTCCCCGGAAAAGACTGTATGCTTCGGGCCATAACAGAAGA<br>GAGATCTGAGCCTTCACCACAGCAAGTTTACTCACCTCCCAGAGGCAAGCCGA<br>GAGCACACCTGACAATTAAGAAACAAACCCCAGCACCACATCTGAAAAATCAG<br>CTCTCTGCTCTACACTGGGAACATGACCTAGGGATGGCCTTCACCAAGAACGG<br>GATGAAGTACATCAACAAATCCCTGGTGATCCCAGAGTCAGGAGACTATTTCA<br>TCTACTCCCAGATCACATTCCGAGGGACCACATCTGTGTGGTGACATCAGT<br>CGGGGGAGACGACCAAACAAGCCAGACTCCATCACCATGGTTATCACCAAGGT<br>AGCAGACAGCTACCCTGAGCCTGCCCGCCTACTAACAGGGTCCAAGTCTGTGT<br>GTGAAATAAGCAACAACTGGTTCCAGTCCCTCTACCTTGGGGCCACGTTCTCC<br>TTGGAAGAAGGGAGACAGACTAATGGTAAACGTCAGTGACATCTCCTTGGTGGA<br>TTACACAAAAGAAGATAAAACTTTCTTTGGAGCTTTCTTGCTATAAGGAGGAG<br>AAAACCATCATTCCAAGGGGCTCCCCTGCCTCCTACTTTCCAATTTCCTTTTC<br>TCATATGGATCTATAAACAGGGGCTTTAGAGGGATCAGGGAAGGGGACAGTGG<br>TTTAGCTATATAATTTAGGAACCCAATATTGATCCGTATATGCCTTATGGACT<br>AAAATAGTAAATGGAAAACCCAGTACAGCTCATGTTTGATAGAGACCTGCTGG<br>GTTTTAAAAATTGAAACACGCCTCATCCAATGGCACAATCTACTGATTTCAGG<br>ACAGAACCTTTCCACAGTGCCCTCTGTCCAAGTCCTTTCTGAATTCAGCAGTT<br>CAGTTAGAGCTGAATTCGACAATGAACTTACTCCAGATCAAGAGCTAAAGACA<br>GAATCCAAAGAAAGACTGAGAAAATGATGTTATTTCTCCAAGAGGCAATGCAT<br>TTCCACATTCTTTTGTGCCTAACCTAAAAAATAAGAAAGAAGAAAGGAAGGAA<br>GGAAGGAAGGAAGGAAGGAAGGAAGGAAGGAAGGAAGGAAGGAAGGAAGGAAG<br>GAAGGAAGGGACAAGAAAAGACAAGACAAGACAAGAAAAAAGAAAAAATGGTA<br>TTTCTCGTGAATATTCCCTAAAAGGAATTGGTTTTCTGCTGTGAAGGAGAAAC<br>CTCACCTTTCTTCTGATTGCATCCTTTAGTATCCAAACATACAAGTGGGAATT<br>CCAAATGCACATGGAACATAGAACACTTTTATTATTGTGAGAACATGTTTATT<br>GAGTACCTACTATGCTCTGGGCACTCAGCCCACAGGACCATGAAGAGAAAGTC<br>AAATTTTCTTAAAAACTAAATGAATCCTCAATACATACTTCCTGATCAACTAC<br>CACTCAAATGTATAACTTCCAAAGTATAACTTCAAGTCAGCCATCTAGGTGG<br>TTTCTTGGGTAAAGGTGCTTGTCATTAAGCCTGACACCTGGGTTTGACCTCCC<br>AGAACCCAAAAGCTGGAAGGAGAGAATTGGTTCCCACAAATTATCCTCAAACC<br>CCCATACAAATGATGTGGCATGCACACATGTAACTAAATAAATAAGTGTAAAA<br>CAAAAACAAAAACAAAATTTTAAAGAAAAATTTCAAGTCCTGAAAGACAGCAT<br>TCCTGAGAATGTTGTCTCCATCGTTGTCCAGTATAGGCTAACCAGCTGATAGA<br>GACACTGAAGGAATTTAAAGACAGACATCAAGTGAAATGGAGCACTGTAGAAA<br>CACTTGATTCATGCCAGGAGTCAATGTACTATGAAGACCAACAACAAAGTGTC<br>AGTCATCAAATCCAGAGGTGTTTATCTAGATCTGCTTTCAAGTTTGGTTTGCA<br>GCCTTTATATAGTCTCTATTACAAATGCTCGTGTCATGGTAGATGCCACAAGG<br>AGTCAGAGGGTAAACTTAGCCCCAAACCACTGCTGAGCCATCTTCTAGGAAAC<br>CTTCGAAGCAGAGCTGGGCAGCGTGACTCCCACACAATGACTGGGAAAGTAGT<br>AGCTGATCAAAATTTGTTGAGTAATAATTTGTTAGAAAATTCATCTCCACTGC<br>CTACTAAACCTAAGTTGTATACTATCTAGCTTCTGCTAAGCCAACTTACATTG<br>GCCACTTTTTCTGTCTTCAACTTCTTGAAGTATCACAGGTCTCAGTGAGAACA<br>CAGGGAAAGGTGAGGTCGCCTTCCCCTGGTTCTTCATAGGGGAAACCACACCT<br>GAAAGAAGATGAGCAGCCTGAGGTGACCTGGAGGAAGGGCTGTCTCAGAAGAA<br>GGACTTATTTTTTGGCTTAGGTCTAAAACCTTGAGAGTAATGCTCACTGGTCA<br>ATTGAGGATGCTTTATCAATGACTCCAGTCTGACTCCAAGGTCAGAAAGGAGA<br>GTGAGATGCTCTCTCTGCCTGCATATATCTTCATGGAACATGAGAATATTGAG<br>CAACATAGACTTATAGGAAAACACTTGCCCAAAAGTAGCCAGAGTGACCTGGT<br>CATCCCCTCTACTAAACCCAAGCTTTGTGTCAAGGGCCTTCAAAGCTGCCCAG<br>AAGTGATCTGGATGGCTTGGGAATTTATCCAAGCAGGAATTTCCTGACAGCC<br>AAAGATGCTTGAGTCCTTGTGCCTGACATGCATTTATTTTGCCCCTGTTTATT<br>GAAGACTGTAACTGTTGATTTGTGGGTATACATACATACATACATACATACAT<br>ACATACATACATACATATGCTGTCATGAAGGCAGCATCAAACATTACTAATTG<br>GACTCAAACCAGCATTTCTGTTTCCAAGATACTAAGTATTCCCATGCAAACAG<br>GAGCATGCTATTTTTCTAAAGCAAAATGAAAAAAATAGTTTTGAAAGTATATA<br>TATGATGGAGTCAAGTGTAATGGCATACATCTGTAAACCCAGCACATGGGATG<br>CTGAGCCAGGAGGATTGCCGTGAGTTTGAGGAGAACAGGGGCTAAATAGTAAT<br>TTTCAGGAAAGCCTTGCCTATATAACAAGACCTTGTCTCAAATGAAAAAAAAA<br>AAAAAAATAGACCCCAGGCTGGTCCTTGGAGATAAGGTAATATATTCATTGGG<br>TGAGGGGGTGTGTGTTTTGGAAAATAGTTAATTTAGTGAGAAATGCTTTTCGG<br>TCAAATGCATCTCAAAGGCTGCTGAATTCAAATCGGGTCTGTAAATGCTTACC<br>TAGTGCTTGCTTGCCCTGGGACAGAGACATAAATTACTTTAGTCTCAGATCC<br>ACTCGTTCTAACAGATTGGCATCTCCATCGTCTGTGGAGCTTTTAATCACTCT<br>GTTTGTATTAGCTAATTAATTAGCTAACTTGAGACACACTGATATTTTCTTAT<br>TATAAACATGGGTGCCATTTGATAAAAGACAATCATTAACAAAATGGTTCGAA<br>TTTCCGCTTAAGTGATCTTCTTTTTTCCTTTTCATTTTTTTAACTAGCTAAT<br>CAAAGGTAGTTTCCCAAAAATAAATGCAAAGGGAGTATAAAGAAAAAATTCCC<br>TGTGGTGGGAGCTAGTATTGAAACAACAGTATCAAAGAGGCTGTTACCTACTG<br>GCCTCAAATTTTGGCAGGAACGCCTTTGAAAATGTTAGAACTTTACGGACAGC<br>CTAGAGGTGCTTTGAAAGTCTCTGTTGCCAACAAAAGCCATTAATCAGCATG<br>CGGCACAGGTTACTCAAATTTTGACCTTGACTGTTTTTTAGATCTGTTACACA<br>GAACACAACTTCTGGGCTGTAATCTCTGATGTGGATTTGGTGATTTACTAAGG<br>TACCGTGGGAAACAAGGAAAGTGTACTTGTACCACATCGTTTCTCAGTGCATG |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | TCAGAGTCTACTCAACAGCAGGGCATGCCAGAGCCTTGGATACATTCCGGGAC<br>AAACTATGTCACTCCTAAGGAAATTCCAAGTGTGTGCCTGTCAAGCACTCTGG<br>ATCATAGAAGCCCACGAGTTCACTGTGCACAAGGCACAGCCATGGCCAGCACT<br>CTCTTGCATGGTATTTCTCTTAAGCTCTTACTCAATCACGGTCCCATGATTGT<br>GACATTGGGATTAATTGCTTGAGCAGGTTTATTTACAGTCTGTTCCTTGCAA<br>AATACATGCAGATATGTCTGGCCTCAAAATCCCCTGATTGTTTAGGGCTTAG<br>AGAATACTGGGGATGTTTTTGCTGTTTTCAGATGTACTTTATTTAAGCTTGCA<br>GAATTACCCTGAATATTAACAGTGTTCTAAGATATTGCCTGCTAGCTTCTGGC<br>TAATTTACTAGTGGTGACAGTATCAGATCAGAGTATCTATATTTATGTCTTGC<br>TATTATAGTTAAAACTTCCTGATCTCTGTAACACACTCACCCCTACCTCATCT<br>ATCTACCCATCTTGTGGATGTAGCTGTGAGAAGACTCACAAGCCCGAGTTGCA<br>GTTACTTTTCTGAAGCAACATAGTATGTTAATGGAATGGCCAGAACTCTACTC<br>TTGGCACATGGCACTGAATTTGATGCCACTAAAAGAAAAATTGAAGGCAGAAA<br>TATTTTTTACTATGCATGGGACAACGTAGAAGAGCAAGGAGACTGCTTACACA<br>TGGTGGTCACATCTCTGGCTTCATCCCTAAACCAATTTTCTGACCCCAAGTCG<br>ATTTTTTTTCATGTAGTTATTGTTCATTTTCTGGAAAGAGTCAAGCAAAAAGA<br>GAGTTTTATAGAAACCATTGCATCATGGAGGTCAGGGGAGGGATTAAGCCAAA<br>GAATTCCTTCTCCAAATCTATAGCCATATGGCCACCCTTTGGTGTACTTCTAT<br>TTGATCATGACAAACCTGAGAGCCCTGCCCAGAGTTCAGTGGATCCTAATGAA<br>CTCCAAGAGTAATTCATTCCCTCACCAACTCTAGGGGCTTGGCCAGTGCAGAA<br>AATGTCATGGGATTTTAAAGTTAACATGAGCTGCTATCCAAACTTATGTCTCT<br>TTAAGAATGGAGAGACACAGGCCAGGAGAGGTAACATATGAAGCCTGGTATTG<br>GGCAGTAGCTTGATGGAGTATTGAGGCTAAAAGTAGACTTCCTGCCCCTGACC<br>ATACACAACACCCTTTCAGTTTGATCCATGGTGGTCTTATTCTACTTTATTTT<br>GAGCACCTGTCACACCTAGTTACTGTCATGCCAAGAAGGTCCATAACAGGCAA<br>ATCCTACTCTGCTGTGTGCACACAAGAGGAAGGAGGCTCACAGTAGCAAGTAA<br>ACAGATAAGCAAACGTACACGATTTTCGTCTTAAAGTCATTAAGACACACGCG<br>TACCCCTCTTTTGTTTCAGAGGGTATACAGGCTGAACAGATGTCAGTGTTCAC<br>CTATTCTTATTGATAAGCCCCATGTGCTTTCATTGGTTGAATGTTTTATGTTA<br>AAACGTCATATTGCCATCGTAAAATGCATATTGTATGTTGTTGGGTATATAAT<br>TAACTAATATGCATCGCATGTATGAATTCTAATCTCTGTAAATGAAAACTTAT<br>ATATGTTAACATATGTAATAGTTATAATTTAATAAACTGACACTGGAGACTAC<br>(SEQ ID NO: 135)<br><br>>NP_796345.4 tumor necrosis factor ligand superfamily<br>member 15 [*Mus musculus*]<br>MAEELGLGFGEGVPVEVLPEGCRHRPEARAGLAARSKACLALTCCLLSFPILA<br>GLSTLLMAGQLRVPGKDCMLRAITEERSEPSPQQVYSPPRGKPRAHLTIKKQT<br>PAPHLKNQLSALHWEHDLGMAFTKNGMKYINKSLVIPESGDYFIYSQITFRGT<br>TSVCGDISRGRRPNKPDSITMVITKVADSYPEPARLLTGSKSVCEISNNWFQS<br>LYLGATFSLEEGDRLMVNVSDISLVDYTKEDKTFFGAFLL (SEQ ID NO:<br>136) |
| Human CD80 | >NM_005191.4 *Homo sapiens* CD80 molecule (CD80), mRNA<br>AAACCCTCTGTAAAGTAACAGAAGTTAGAAGGGGAAATGTCGCCTCTCTGAAG<br>ATTACCCAAAGAAAAAGTGATTTGTCATTGCTTTATAGACTGTAAGAAGAGAA<br>CATCTCAGAAGTGGAGTCTTACCCTGAAATCAAAGGATTTAAAGAAAAAGTGG<br>AATTTTTCTTCAGCAAGCTGTGAAACTAAATCCACAACCTTTGGAGACCCAGG<br>AACACCCTCCAATCTCTGTGTGTTTTGTAAACATCACTGGAGGGTCTTCTACG<br>TGAGCAATTGGATTGTCATCAGCCCTGCCTGTTTTGCACCTGGGAAGTGCCCT<br>GGTCTTACTTGGGTCCAAATTGTTGGCTTTCACTTTTGACCCTAAGCATCTGA<br>AGCCATGGGCCACACACGGAGGCAGGGAACATCACCATCCAAGTGTCCATACC<br>TCAATTTCTTTCAGCTCTTGGTGCTGGCTGGTCTTTCTCACTTCTGTTCAGGT<br>GTTATCCACGTGACCAAGGAAGTGAAAGAAGTGGCAACGCTGTCCTGTGGTCA<br>CAATGTTTCTGTTGAAGAGCTGGCACAAACTCGCATCTACTGGCAAAAGGAGA<br>AGAAAATGGTGCTGACTATGATGTCTGGGGACATGAATATATGGCCCGAGTAC<br>AAGAACCGGACCATCTTTGATATCACTAATAACCTCTCCATTGTGATCCTGGC<br>TCTGCGCCCATCTGACGAGGGCACATACGAGTGTGTTGTTCTGAAGTATGAAA<br>AAGACGCTTTCAAGCGGGAACACCTGGCTGAAGTGACGTTATCAGTCAAAGCT<br>GACTTCCCTACACCTAGTATATCTGACTTTGAAATTCCAACTTCTAATATTAG<br>AAGGATAATTTGCTCAACCTCTGGAGGTTTTCCAGAGCCTCACCTCTCCTGGT<br>TGGAAAATGGAGAAGAATTAAATGCCATCAACACAACAGTTTCCCAAGATCCT<br>GAAACTGAGCTCTATGCTGTTAGCAGCAAACTGGATTTCAATATGACAACCAA<br>CCACAGCTTCATGTGTCTCATCAAGTATGGACATTTAAGAGTGAATCAGACCT<br>TCAACTGGAATACAACCAAGCAAGAGCATTTTCCTGATAACCTGCTCCCATCC<br>TGGGCCATTACCTTAATCTCAGTAAATGGAATTTTTGTGATATGCTGCCTGAC<br>CTACTGCTTTGCCCCAAGATGCAGAGAGAGAAGGAGGAATGAGAGATTGAGAA<br>GGGAAAGTGTACGCCCTGTATAACAGTGTCCGCAGAAGCAAGGGGCTGAAAAG<br>ATCTGAAGGTCCCACCTCCATTTGCAATTGACCTCTTCTGGGAACTTCCTCAG<br>ATGGACAAGATTACCCCACCTTGCCCTTTACGTATCTGCTCTTAGGTGCTTCT<br>TCACTTCAGTTGCTTTGCAGGAAGTGTCTAGAGGAATATGGTGGGCACAGAAG<br>TAGCTCTGGTGACCTTGATCAAGGTGTTTTGAAATGCAGAATTCTTGAGTTCT<br>GGAAGGGACTTTAGAGAATACCAGTGTTATTAATGACAAAGGCACTGAGGCCC<br>AGGGAGGTGACCCGAATTATAAAGGCCAGCGCCAGAACCCAGATTTCCTAACT<br>CTGGTGCTCTTTCCCTTTATCAGTTTGACTGTGGCCTGTTAACTGGTATATAC |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | ATATATATGTCAGGCAAAGTGCTGCTGGAAGTAGAATTTGTCCAATAACAGGT<br>CAACTTCAGAGACTATCTGATTTCCTAATGTCAGAGTAGAAGATTTTATGCTG<br>CTGTTTACAAAAGCCCAATGTAATGCATAGGAAGTATGGCATGAACATCTTTA<br>GGAGACTAATGGAAATATTATTGGTGTTTACCCAGTATTCCATTTTTTTCATT<br>GTGTTCTCTATTGCTGCTCTCTCACTCCCCCATGAGGTACAGCAGAAAGGAGA<br>ACTATCCAAAACTAATTTCCTCTGACATGTAAGACGAATGATTTAGGTACGTC<br>AAAGCAGTAGTCAAGGAGGAAAGGGATAGTCCAAAGACTTAACTGGTTCATAT<br>TGGACTGATAATCTCTTTAAATGGCTTTATGCTAGTTTGACCTCATTTGTAAA<br>ATATTTATGAGAAAGTTCTCATTTAAAATGAGATCGTTGTTTACAGTGTATGT<br>ACTAAGCAGTAAGCTATCTTCAAATGTCTAAGGTAGTAACTTTCCATAGGGCC<br>TCCTTAGATCCCTAAGATGGCTTTTTCTCCTTGGTATTTCTGGGTCTTTCTGA<br>CATCAGCAGAGAACTGGAAAGACATAGCCAACTGCTGTTCATGTTACTCATGA<br>CTCCTTTCTCTAAAACTGCCTTCCACAATTCACTAGACCAGAAGTGGACGCAA<br>CTTAAGCTGGGATAATCACATTATCATCTGAAAATCTGGAGTTGAACAGCAAA<br>AGAAGACAACATTTCTCAAATGCACATCTCATGGCAGCTAAGCCACATGGCTG<br>GGATTTAAAGCCTTTAGAGCCAGCCCATGGCTTTAGCTACCTCACTATGCTGC<br>TTCACAAACCTTGCTCCTGTGTAAAACTATATTCTCAGTGTAGGGCAGAGAGG<br>TCTAACACCAACATAAGGTACTAGCAGTGTTTCCCGTATTGACAGGAATACTT<br>AACTCAATAATTCTTTTCTTTTCCATTTAGTAACAGTTGTGATGACTATGTTT<br>CTATTCTAAGTAATTCCTGTATTCTACAGCAGATACTTTGTCAGCAATACTAA<br>GGGAAGAAACAAAGTTGAACCGTTTCTTTAATAA (SEQ ID NO: 137)<br><br>>NP_005182.1 T-lymphocyte activation antigen CD80<br>precursor [Homo sapiens]<br>MGHTRRQGTSPSKCPYLNFFQLLVLAGLSHFCSGVIHVTKEVKEVATLSCGHN<br>VSVEELAQTRIYWQKEKKMVLTMMSGDMNIWPEYKNRTIFDITNNLSIVILAL<br>RPSDEGTYECVVLKYEKDAFKREHLAEVTLSVKADFPTPSISDFEIPTSNIRR<br>IICSTSGGFPEPHLSWLENGEELNAINTTVSQDPETELYAVSSKLDFNMTTNH<br>SFMCLIKYGHLRVNQTFNWNTTKQEHFPDNLLPSWAITLISVNGIFVICCLTY<br>CFAPRCRERRRNERLRRESVRPV (SEQ ID NO: 138) |
| Mouse CD80 | >NM_009855.2 Mus musculus CD80 antigen (Cd80),<br>transcript variant 2, mRNA<br>GAGTTTTATACCTCAATAGACTCTTACTAGTTTCTCTTTTTCAGGTTGTGAAA<br>CTCAACCTTCAAAGACACTCTGTTCCATTTCTGTGGACTAATAGGATCATCTT<br>TAGCATCTGCCGGGTGGATGCCATCCAGGCTTCTTTTTCTACATCTCTGTTTC<br>TCGATTTTTGTGAGCCTAGGAGGTGCCTAAGCTCCATTGGCTCTAGATTCCTG<br>GCTTTCCCCATCATGTTCTCCAAAGCATCTGAAGCTATGGCTTGCAATTGTCA<br>GTTGATGCAGGATACACCACTCCTCAAGTTTCCATGTCCAAGGCTCATTCTTC<br>TCTTTGTGCTGCTGATTCGTCTTTCACAAGTGTCTTCAGATGTTGATGAACAA<br>CTGTCCAAGTCAGTGAAAGATAAGGTATTGCTGCCTTGCCGTTACAACTCTCC<br>TCATGAAGATGAGTCTGAAGACCGAATCTACTGGCAAAAACATGACAAAGTGG<br>TGCTGTCTGTCATTGCTGGGAAACTAAAAGTGTGGCCCGAGTATAAGAACCGG<br>ACTTTATATGACAACACTACCTACTCTCTTATCATCCTGGGCCTGGTCCTTTC<br>AGACCGGGGCACATACAGCTGTGTCGTTCAAAAGAAGGAAAGAGGAACGTATG<br>AAGTTAAACACTTGGCTTTAGTAAAGTTGTCCATCAAAGCTGACTTCTCTACC<br>CCCAACATAACTGAGTCTGGAAACCCATCTGCAGACACTAAAAGGATTACCTG<br>CTTTGCTTCCGGGGGTTTCCCAAAGCCTCGCTTCTCTTGGTTGGAAAATGGAA<br>GAGAATTACCTGGCATCAATACGACAATTTCCCAGGATCCTGAATCTGAATTG<br>TACACCATTAGTAGCCAACTAGATTTCAATACGACTCGCAACCACACCATTAA<br>GTGTCTCATTAAATATGGAGATGCTCACGTGTCAGAGGACTTCACCTGGGAAA<br>AACCCCCAGAAGACCCTCCTGATAGCAAGAACACACTTGTGCTCTTTGGGGCA<br>GGATTCGGCGCAGTAATAACAGTCGTCGTCATCGTTGTCATCATCAAATGCTT<br>CTGTAAGCACAGAAGCTGTTTCAGAAGAAATGAGGCAAGCAGAGAAACAAACA<br>ACAGCCTTACCTTCGGGCCTGAAGAAGCATTAGCTGAACAGACCGTCTTCCTT<br>TAGTTCTTCTCTGTCCATGTGGGATACATGGTATTATGTGGCTCATGAGGTAC<br>AATCTTTCTTTCAGCACCGTGCTAGCTGATCTTTCGGACAACTTGACACAAGA<br>TAGAGTTAACTGGGAAGAGAAAGCCTTGAATGAGGATTTCTTTCCATCAGGAA<br>GCCTACGGGCAAGTTTGCTGGGCCTTTGATTGCTTGATGACTGAAGTGGAAAG<br>GCTGAGCCCACTGTGGGTGGTGCTAGCCCTGGGCAGGGGCAGGTGACCCTGGG<br>TGGTATAAGAAAAAGAGCTGTCACTAAAAGGAGAGGTGCCTAGTCTTACTGCA<br>ACTTGATATGTCATGTTTGGTTGGTGTCTGTGGGAGGCCTGCCCTTTTCTGAA<br>GAGAAGTGGTGGGAGAGTGGATGGGTGGGGGCAGAGGAAAAGTGGGGGAGAG<br>GGCCTGGGAGGAGAGGAGGGAGGGGGACGGGGTGGGGGTGGGGAAAACTATGG<br>TTGGGATGTAAAAACGATAATAATATAAATATTAAATAAAAAGAGAGTATTGA<br>GCAAA (SEQ ID NO: 139)<br><br>>NP_033985.3 T-lymphocyte activation antigen CD80<br>precursor [Mus musculus]<br>MACNCQLMQDTPLLKFPCPRLILLFVLLIRLSQVSSDVDEQLSKSVKDKVLLP<br>CRYNSPHEDESEDRIYWQKHDKVVLSVIAGKLKVWPEYKNRTLYDNTTYSLII<br>LGLVLSDRGTYSCVVQKKERGTYEVKHLALVKLSIKADFSTPNITESGNPSAD |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | TKRITCFASGGFPKPRFSWLENGRELPGINTTISQDPESELYTISSQLDFNTT<br>RNHTIKCLIKYGDAHVSEDFTWEKPPEDPPDSKNTLVLFGAGFGAVITVVVIV<br>VIIKCFCKHRSCFRRNEASRETNNSLTFGPEEALAEQTVFL (SEQ ID NO:<br>140) |
| Human CD86 | >NM_175862.5 Homo sapiens CD86 molecule (CD86),<br>transcript variant 1, mRNA<br>AGTCATTGCCGAGGAAGGCTTGCACAGGGTGAAAGCTTTGCTTCTCTGCTGCT<br>GTAACAGGGACTAGCACAGACACACGGATGAGTGGGGTCATTTCCAGATATTA<br>GGTCACAGCAGAAGCAGCCAAAATGGATCCCCAGTGCACTATGGGACTGAGTA<br>ACATTCTCTTTGTGATGGCCTTCCTGCTGTCTCTGGTGCTGCTCCTCTGAAGATT<br>CAAGCTTATTTCAATGAGACTGCAGACCTGCCATGCCAATTTGCAAACTCTCA<br>AAACCAAAGCCTGAGTGAGCTAGTAGTATTTTGGCAGGACCAGGAAAACTTGG<br>TTCTGAATGAGGTATACTTAGGCAAAGAGAAATTTGACAGTGTTCATTCCAAG<br>TATATGGGCCGCACAAGTTTTGATTCGGACAGTTGGACCCTGAGACTTCACAA<br>TCTTCAGATCAAGGACAAGGGCTTGTATCAATGTATCATCCATCACAAAAAGC<br>CCACAGGAATGATTCGCATCCACCAGATGAATTCTGAACTGTCAGTGCTTGCT<br>AACTTCAGTCAACCTGAAATAGTACCAATTTCTAATATAACAGAAAATGTGTA<br>CATAAATTTGACCTGCTCATCTATACACGGTTACCCAGAACCTAAGAAGATGA<br>GTGTTTTGCTAAGAACCAAGAATTCAACTATCGAGTATGATGGTGTTATGCAG<br>AAATCTCAAGATAATGTCACAGAACTGTACGACGTTTCCATCAGCTTGTCTGT<br>TTCATTCCCTGATGTTACGAGCAATATGACCATCTTCTGTATTCTGGAAACTG<br>ACAAGACGCGGCTTTTATCTTCACCTTTCTCTATAGAGCTTGAGGACCCTCAG<br>CCTCCCCCAGACCACATTCCTTGGATTACAGCTGTACTTCCAACAGTTATTAT<br>ATGTGTGATGGTTTTCTGTCTAATTCTATGGAAATGGAAGAAGAAGAAGCGGC<br>CTCGCAACTCTTATAAATGTGGAACCAACACAATGGAGAGGGAAGAGAGTGAA<br>CAGACCAAGAAAAGAGAAAAAATCCATATACCTGAAAGATCTGATGAAGCCCA<br>GCGTGTTTTTAAAAGTTCGAAGACATCTTCATGCGACAAAAGTGATACATGTT<br>TTTAATTAAAGAGTAAAGCCCATACAAGTATTCATTTTTTCTACCCTTTCCTT<br>TGTAAGTTCCTGGGCAACCTTTTTGATTTCTTCCAGAAGGCAAAAAGACATTA<br>CCATGAGTAATAAGGGGGCTCCAGGACTCCCTCTAAGTGGAATAGCCTCCCTG<br>TAACTCCAGCTCTGCTCCGTATGCCAAGAGGAGACTTTAATTCTCTTACTGCT<br>TCTTTTCACTTCAGAGCACACTTATGGGCCAAGCCCAGCTTAATGGCTCATGA<br>CCTGGAAATAAAATTTAGGACCAATACCTCCTCCAGATCAGATTCTTCTCTTA<br>ATTTCATAGATTGTGTTTTTTTTTAAATAGACCTCTCAATTTCTGGAAAACT<br>GCCTTTTATCTGCCCAGAATTCTAAGCTGGTGCCCCACTGAATTTTGTGTGTA<br>CCTGTGACTAAACAACTACCTCCTCAGTCTGGGTGGGACTTATGTATTTATGA<br>CCTTATAGTGTTAATATCTTGAAACATAGAGATCTATGTACTGTAATAGTGTG<br>ATTACTATGCTCTAGAGAAAAGTCTACCCCTGCTAAGGAGTTCTCATCCCTCT<br>GTCAGGGTCAGTAAGGAAAACGGTGGCCTAGGGTACAGGCAACAATGAGCAGA<br>CCAACCTAAATTTGGGAAATTAGGAGAGGCAGAGATAGAACCTGGAGCCACT<br>TCTATCTGGGCTGTTGCTAATATTGAGGAGGCTTGCCCCACCCAACAAGCCAT<br>AGTGGAGAGAACTGAATAAACAGGAAAATGCCAGAGCTTGTGAACCCTGTTTC<br>TCTTGAAGAACTGACTAGTGAGATGGCCTGGGGAAGCTGTGAAAGAACCAAAA<br>GAGATCACAATACTCAAAAGAGAGAGAGAGAAAAAAGAGAGATCTTGATCC<br>ACAGAAATACATGAAATGTCTGGTCTGTCCACCCCATCAACAAGTCTTGAAAC<br>AAGCAACAGATGGATAGTCTGTCCAAATGGACATAAGACAGACAGCAGTTTCC<br>CTGGTGGTCAGGGAGGGGTTTTGGTGATACCCAAGTTATTGGGATGTCATCTT<br>CCTGGAAGCAGAGCTGGGGAGGGAGAGCCATCACCTTGATAATGGGATGAATG<br>GAAGGAGGCTTAGGACTTTCCACTCCTGGCTGAGAGAGGAAGAGCTGCAACGG<br>AATTAGGAAGACCAAGACACAGATCACCCGGGGCTTACTTAGCCTACAGATGT<br>CCTACGGGAACGTGGGCTGGCCCAGCATAGGGCTAGCAAATTTGAGTTGGATG<br>ATTGTTTTTGCTCAAGGCAACCAGAGGAAACTTGCATACAGAGACAGATATAC<br>TGGGAGAAATGACTTTGAAAACCTGGCTCTAAGGTGGGATCACTAAGGGATGG<br>GGCAGTCTCTGCCCAAACATAAAGAGAACTCTGGGGAGCCTGAGCCACAAAAA<br>TGTTCCTTTATTTTATGTAAACCCTCAAGGGTTATAGACTGCCATGCTAGACA<br>AGCTTGTCCATGTAATATTCCCATGTTTTTACCCTGCCCCTGCCTTGATTAGA<br>CTCCTAGCACCTGGCTAGTTTCTAACATGTTTTGTGCAGCACAGTTTTTAATA<br>AATGCTTGTTACATTCA (SEQ ID NO: 141) |
| | >NP_787058.5 T-lymphocyte activation antigen CD86<br>isoform 1 precursor [Homo sapiens]<br>MDPQCTMGLSNILFVMAFLLSGAAPLKIQAYFNETADLPCQFANSQNQSLSEL<br>VVFWQDQENLVLNEVYLGKEKFDSVHSKYMGRTSFDSDSWTLRLHNLQIKDKG<br>LYQCIIHHKKPTGMIRIHQMNSELSVLANFSQPEIVPISNITENVYINLTCSS<br>IHGYPEPKKMSVLLRTKNSTIEYDGVMQKSQDNVTELYDVSISLSVSFPDVTS<br>NMTIFCILETDKTRLLSSPFSIELEDPQPPPDHIPWITAVLPTVIICVMVFCL<br>ILWKWKKKKRPRNSYKCGTNTMEREESEQTKKREKIHIPERSDEAQRVFKSSK<br>TSSCDKSDTCF (SEQ ID NO: 142) |
| Mouse CD86 | >NM_019388.3 Mus musculus CD86 antigen (Cd86), mRNA<br>ATTGCTGAGGAAGAAAGAGGAGCAAGCAGACGCGTAAGAGTGGCTCCTGTAGG<br>CAGCACGGACTTGAACAACCAGACTCCTGTAGACGTGTTCCAGAACTTACGGA<br>AGCACCCACGATGGACCCCAGATGCACCATGGGCTTGGCAATCCTTATCTTTG<br>TGACAGTCTTGCTGATCTCAGATGCTGTTTCCGTGGGAGACGCAAGCTTATTTC |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | AATGGGACTGCATATCTGCCGTGCCCATTTACAAAGGCTCAAAACATAAGCCT<br>GAGTGAGCTGGTAGTATTTTGGCAGGACCAGCAAAAGTTGGTTCTGTACGAGC<br>ACTATTTGGGCACAGAGAAACTTGATAGTGTGAATGCCAAGTACCTGGGCCGC<br>ACGAGCTTTGACAGGAACAACTGGACTCTACGACTTCACAATGTTCAGATCAA<br>GGACATGGGCTCGTATGATTGTTTTATACAAAAAAAGCCACCCACAGGATCAA<br>TTATCCTCCAACAGACATTAACAGAACTGTCAGTGATCGCCAACTTCAGTGAA<br>CCTGAAATAAAACTGGCTCAGAATGTAACAGGAAATTCTGGCATAAATTTGAC<br>CTGCACGTCTAAGCAAGGTCACCCGAAACCTAAGAAGATGTATTTTCTGATAA<br>CTAATTCAACTAATGAGTATGGTGATAACATGCAGATATCACAAGATAATGTC<br>ACAGAACTGTTCAGTATCTCCAACAGCCTCTCTCTTTCATTCCCGGATGGTGT<br>GTGGCATATGACCGTTGTGTGTGTTCTGGAAACGGAGTCAATGAAGATTTCCT<br>CCAAACCTCTCAATTTCACTCAAGAGTTTCCATCTCCTCAAACGTATTGGAAG<br>GAGATTACAGCTTCAGTTACTGTGGCCCTCCTCCTTGTGATGCTGCTCATCAT<br>TGTATGTCACAAGAAGCCGAATCAGCCTAGCAGGCCCAGCAACACAGCCTCTA<br>AGTTAGAGCGGGATAGTAACGCTGACAGAGAGACTATCAACCTGAAGGAACTT<br>GAACCCCAAATTGCTTCAGCAAAACCAAATGCAGAGTGAAGGCAGTGAGAGCC<br>TGAGGAAAGAGTTAAAAATTGCTTTGCCTGAAATAAGAAGTGCAGAGTTTCTC<br>AGAATTCAAAAATGTTCTCAGCTGATTGGAATTCTACAGTTGAATAATTAAAG<br>AACAAAATACACAACAGTGTCCATATTTTATCCTGTTTCCTTTCCAAGTTTTT<br>GGGCAATGTCAATTGTGTCCCCTATGCCAGGAGCAGACATCTATTTTGTCTTG<br>CTTTGTTTAACTCAGTGCACACTCATAGGCCAAGAGCACTGAAATGGCTTCTT<br>TCCCAGGAATAACATTTTGGATCAATCTCTCCTACTTGAGATCAGATTCTTCT<br>TCTAATTTTGCATAGTGTGTTTTTATATGGAACTCCTTGTTGTAGGAATACTG<br>GCTTTTATCTGTCTTGCACACTTGCATACTTATATACTTATACCTGGACAGCT<br>ACCTCTTCAGTCAGGATGGGAGTGGTATATTTGGTGATGTTATTTGATGTGTT<br>CGTGTTGCTATCTTAAAACAGCAAAGAGCATATACTATAGTAGCTCAACTACA<br>ATGATCTAGAGAAAGACCCAGCACTTATAAGAAACACTGTCCCTCCATCAGGG<br>TCAATAATGAATACAATGACCTAAGTAATATACAGGTGACAGCAACAGCACAG<br>AGTTCTCAGTGCTGGCAAATCAAGAAACACAAATATGGAACCATCTCTAGATC<br>CAAGAGCCACTCCTACCTGGGCTGCCACAGATACTGGAAGAATCCACCTGCCT<br>GGCCAGCAAGTCACAACTTAGCAGGCAGCACTGAAGAAAGCAAGATGTACTGT<br>ATGCCCTTTTAAGAAAATGCCTGGAAAGGTCTGGAGAATGCTGTGCAAGGATA<br>AGACAGCCAAGCACTCAAAACCAGGAGACATCACTAGAATCCAACCAACAAT<br>GTTTATGGAAGGACTGATCTGCCCAGTCCATTGAAAAGTCAAGAGGTCAGAGA<br>TAGACCAGTGTGTGTCTCAATGGATGTAGATATCAGCCACCTCGGTGCTCAAC<br>AGGTATTTTATGATCTCCTTGTTTCAAATTCATCTAGATGTAGAACTAGGGAG<br>AGAGCAGTCACATTGATGAAAGGCTAGGACTCTTTCAGCTCATGGCTTGTGTG<br>GAAGGAGGGAAAGCAGAAATCACAACACTCTGAGACTACTGTAGTCTGCAGAT<br>ACCTGAGTGGGTGTGGCTTGGCCTTTCAAAGGACAAAGAGCAACTAATGCTGA<br>AAGCACATAGTGTATCTATACGGCATGGAATAGTCATCACCCAGACTTAAAGA<br>GAACTTTGGCAGGTCTGAGCAGCAAAATATTGTTGTTTCCATTTTACATAAAG<br>GGCCCTGGAGGGCTATAGACTATTCCGCTGGCAGGGCTCATGCTTGTAATGTG<br>TCCATCTTGATTCACCCTGTGCAGACTCTTAAGATCTGGCCAGTTACCAACAT<br>GTTCTGTACAGAGTGGATTTCAATAAAGTTTTCTTGAATTTTTTCAAG<br>(SEQ ID NO: 143)<br><br>>NP_062261.3 T-lymphocyte activation antigen 0D86 precursor [*Mus musculus*]<br>MDPRCTMGLAILIFVTVLLISDAVSVETQAYFNGTAYLPCPFTKAQNISLSEL<br>VVFWQDQQKLVLYEHYLGTEKLDSVNAKYLGRTSFDRNNWTLRLHNVQIKDMG<br>SYDCFIQKKPPTGSIILQQTLTELSVIANFSEPEIKLAQNVTGNSGINLTCTS<br>KQGHPKPKKMYFLITNSTNEYGDNMQISQDNVTELFSISNSLSLSFPDGVWHM<br>TVVCVLETESMKISSKPLNFTQEFPSPQTYWKEITASVTALLLVMLLIIVCH<br>KKPNQPSRPSNTASKLERDSNADRETINLKELEPQIASAKPNAE (SEQ ID NO: 144) |
| Human LFA-3 (CD58) | >NM_001779.3 *Homo sapiens* CD58 molecule (CD58), transcript variant 1, mRNA<br>GAACTTAGGGCTGCTTGTGGCTGGGCACTCGCGCAGAGGCCGGCCCGACGAGC<br>CATGGTTGCTGGGAGCGACGCGGGCGGGCCCTGGGGGTCCTCAGCGTGGTCT<br>GCCTGCTGCACTGCTTTGGTTTCATCAGCTGTTTTTCCCAACAAATATATGGT<br>GTTGTGTATGGGAATGTAACTTTCCATGTACCAAGCAATGTGCCTTTAAAAGA<br>GGTCCTATGGAAAAAACAAAAGGATAAAGTTGCAGAACTGGAAAATTCTGAAT<br>TCAGAGCTTTCTCATCTTTTAAAAATAGGGTTTATTTAGACACTGTGTCAGGT<br>AGCCTCACTATCTACAACTTAACATCATCAGATGAAGATGAGTATGAAATGGA<br>ATCGCCAAATATTACTGATACCATGAAGTTCTTTCTTTATGTGCTTGAGTCTC<br>TTCCATCTCCCACACTAACTTGTGCATTGACTAATGGAAGCATTGAAGTCCAA<br>TGCATGATACCAGAGCATTACAACAGCCATCGAGGACTTATAATGTACTCATG<br>GGATTGTCCTATGGAGCAATGTAAACGTAACTCAACCAGTATATATTTTAAGA<br>TGGAAAATGATCTTCCACAAAAAATACAGTGTACTCTTAGCAATCCATTATTT<br>AATACAACATCATCAATCATTTTGACAACCTGTATCCCAAGCAGCGGTCATTC<br>AAGACACAGATATGCACTTATACCCATACCATTAGCAGTAATTACAACATGTA<br>TTGTGCTGTATATGAATGGTATTCTGAAATGTGACAGAAAACCAGACAGAACC<br>AACTCCAATTGATTGGTAACAGAAGATGAAGACAACAGCATAACTAAATTATT<br>TTAAAAACTAAAAAGCCATCTGATTTCTCATTTGAGTATTACAATTTTTGAAC |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | AACTGTTGGAAATGTAACTTGAAGCAGCTGCTTTAAGAAGAAATACCCACTAA<br>CAAAGAACAAGCATTAGTTTTGGCTGTCATCAACTTATTATATGACTAGGTGC<br>TTGCTTTTTTTGTCAGTAAATTGTTTTTACTGATGATGTAGATACTTTTGTAA<br>ATAAATGTAAATATGTACACAAGTGA (SEQ ID NO: 145)<br><br>>NP_001770.1 lymphocyte function-associated antigen 3 isoform 1 [Homo sapiens]<br>MVAGSDAGRALGVLSVVCLLHCFGFISCFSQQIYGVVYGNVTFHVPSNVPLKE<br>VLWKKQKDKVAELENSEFRAFSSFKNRVYLDTVSGSLTIYNLTSSDEDEYEME<br>SPNITDTMKFFLYVLESLPSPTLTCALTNGSIEVQCMIPEHYNSHRGLIMYSW<br>DCPMEQCKRNSTSIYFKMENDLPQKIQCTLSNPLFNTTSSIILTTCIPSSGHS<br>RHRYALIPIPLAVITTCIVLYMNGILKCDRKPDRTNSN (SEQ ID NO: 146) |
| Human SLAM (CD150) | >NM_003037.5 Homo sapiens signaling lymphocytic activation molecule family member 1 (SLAMF1), transcript variant 1, mRNA<br>AGACAGCCTCTGCTGCATGACACGAAGCTTGCTTCTGCCTGGCATCTGTGAGC<br>AGCTGCCAGGCTCCGGCCAGGATCCCTTCCTTCTCCTCATTGGCTGATGGATC<br>CCAAGGGGCTCCTCTCCTTGACCTTCGTGCTGTTTCTCTCCCTGGCTTTTGGG<br>GCAAGCTACGGAACAGGTGGGCGCATGATGAACTGCCCAAAGATTCTCCGGCA<br>GTTGGGAAGCAAAGTGCTGCTGCCCCTGACATATGAAAGGATAAATAAGAGCA<br>TGAACAAAAGCATCCACATTGTCGTCACAATGGCAAAATCACTGGAGAACAGT<br>GTCGAGAACAAAATAGTGTCTCTTGATCCATCCGAAGCAGGCCCTCCACGTTA<br>TCTAGGAGATCGCTACAAGTTTTATCTGGAGAATCTCACCCTGGGGATACGGG<br>AAAGCAGGAAGGAGGATGAGGGATGGTACCTTATGACCCTGGAGAAAAATGTT<br>TCAGTTCAGCGCTTTTGCCTGCAGTTGAGGCTTTATGAGCAGGTCTCCACTCC<br>AGAAATTAAAGTTTTAAACAAGACCCAGGAGAACGGGACCTGCACCTTGATAC<br>TGGGCTGCACAGTGGAGAAGGGGGACCATGTGGCTTACAGCTGGAGTGAAAAG<br>GCGGGCACCCACCCACTGAACCCAGCCAACAGCTCCCACCTCCTGTCCCTCAC<br>CCTCGGCCCCAGCATGCTGACAATATCTACATCTGCACCGTGAGCAACCCTA<br>TCAGCAACAATTCCCAGACCTTCAGCCCGTGGCCCGGATGCAGGACAGACCCC<br>TCAGAAACAAAACCATGGGCAGTGTATGCTGGGCTGTTAGGGGGTGTCATCAT<br>GATTCTCATCATGGTGGTAATACTACAGTTGAGAAGAAGAGGTAAAACGAACC<br>ATTACCAGACAACAGTGGAAAAAAAAAGCCTTACGATCTATGCCCAAGTCCAG<br>AAACCAGGTCCTCTTCAGAAGAAACTTGACTCCTTCCCAGCTCAGGACCCTTG<br>CACCACCATATATGTTGCTGCCACAGAGCCTGTCCCAGAGTCTGTCCAGGAAA<br>CAAATTCCATCACAGTCTATGCTAGTGTGACACTTCCAGAGAGCTGACACCAG<br>AGACCAACAAAGGGACTTTCTGAAGGAAATGGAAAAACCAAATGAACACTG<br>AACTTGGCCACAGGCCCCAAGTTTCCTCTGGCAGACATGCTGCACGTCTGTAC<br>CCTTCTCAGATCAACTCCCTGGTGATGTTTCTTCCACATACATCTGTGAAATG<br>AACAAGGAAGTGAGGCTTCCCAAGAATTTAGCTTGCTGTGCAGTGGCTGCAGG<br>CGCAGAACAGAGCGTTACTTGATAACAGCGTTCCATCTTTGTGTTGTAGCAGA<br>TGAAATGGACAGTAATGTGAGTTCAGACTTTGGGCATCTTGCTCTTGGCTGGA<br>ACTGGATAATAAAAATCAGACTGAAAGCCAGGACATCTGAGTACCTATCTCAC<br>ACACTGGACCACCAGTCACAAAGTCTGGAAAAGTTTACATTTTGGCTATCTTT<br>ACTTTGTTCTGGGAGCTGATCATGATAACCTGCAGACCTGATCAAGCCTCTGT<br>GCCTCAGTTTCTCTCTCAGGATAAAGAGTGAATAGAGGCTGAAGGGTGAATTT<br>CTTATTATACATAAAACACTCTGATATTATTGTATAAAGGAAGCTAAGAATAT<br>TATTTTATTTGCAAAACCCAGAAGCTAAAAAGTCAATAAACAGAAAGAATGAT<br>TTTGAGATCTCTGAGTTTTGAACAGTGGACTGGAAACCATGTAAGAGCCTTAA<br>AAGTACAGTTCTGTGCAAATGGCATTCAGTTTTAAAGAAAAACGTAGCAAATG<br>TTTGATGGTGCTGTTACAAAGGAGCTTGGAATACTCAGAGGAACTTGTCCCAT<br>GGTGATTTTTCACTTCTCAAAATGATGTTTAAATCCCAGTTCTCTGTTGATTC<br>CCTTGAACAACAAACCTGGAACCTCAGCTAAGACTCTCTGTGACCAGATTCTG<br>AACCTCTTATATCCAGGGCTTCAAGGGGTATTGCAGGTCAAGGTGTTTCCTAG<br>GCACTTTCTACTCCCTGCATACCTCTCCTCACACTAAATTTATCCTCTAGTAG<br>AAAATTAAGTTATTTTGGTCTAACAGCTTCAAATCTTTGAATGCTCAATAACT<br>TATTTTGCAAGCTGCAGGCAGAAAGAGACTTTTTAAGTAAAGTCCTTTGTTTT<br>TTCCTATTCTCTGCTTTTAGACAGGCTGTCCTCAATTTAAGCCCTGCTTTTTC<br>TTATTGTTTCTTATATAAACTTGGTAAGTACTGTAAGAAACAGCCACTATCAT<br>ACCATTGCATAATAAGGAGCACCAACTTCCCAGCTCAAAACTCAGGTCCTTAT<br>TGCCTTGTATCTTACCTCCTCTATGAGGTCAATTCACATTGTAAGCCTGTTGC<br>TTAGTGCATCTCGTTTCCTGGTACCAGCTTCTTTAATAGAGTTCTTAGTTGCA<br>ATCAACAGAAGCTGGCTTTGGCTTTTTTATGTAGAAAAGGAACCTATTGAAAA<br>GATACTGATTGGTTCCAATAACTGCTAGAAGTTTCTGCAAAACCATGCTTTGA<br>AAGTGAGCAGGAAAAGAAGAGACTAGGCTGTGGCTGGGAGCACAGCCAAAATT<br>ACAAAACCAGCCCAGGGATGATGATCCTGTTCATGCACAGCCACTGTCCCCAG<br>CACTAGGCACAGACTCTACCACTGCCTCACTGTCTCTGGTGGACTTGGAAACT<br>TGATATTACTGTTACTGCTGCACTGTCTGCCATGAAAATGAATTCTCCAGGGT<br>CCCTTCTTCATCCTTTCATCTCTAGCTTATAATTCAAAGTCTGGGATTGAGTG<br>GCCAATCCTAGGTCACATGTCCATGTCCTATCTCCAAGGGGGCTGGGAATTG<br>AATATCTGGCATTTTCCACTTTCACTTCTTATGAATTAAGGAATTCTACAAAT<br>AATAGAAGTGGGATTCAGGTGGTAGGCAGACAAAAAAGCCTCACAATTATCCA<br>CTACGCCACCCTTGTATAACCTTACCCTCATTCACTGTCTACTCTCAAAACTG |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | TGGAGCTACTAATGAAGATTTGTAAACCCGGGCTTATGAGCACCCATTCCTTT<br>ACTACAACTCAGATTGCTCTAGAAGCTCAGTTCCCAGCACTTGGATTTTTCCA<br>GTAGCTGAATTCTACCTGAAGGAAGGGCAGAAACAAAGGGTGAAGAAGAGGCT<br>ATCACTTCCAAGTATCCTGCACCCCTGGGCTCAAGACCTCACTGGGGAGGGAG<br>TCTTTTGGGCCACCCACCCAAACAGCACTGGCATTATGCCTCTCACCCTAGACC<br>ATGGTTACACGTGGTAAAACAACCCCTTCTGGTGATACATTCACAACTCTCTA<br>GTTTCCCCCAAATGGCACTATGGGGAGCGGGAGCTTGCCTTTTCCTCAGACTT<br>AAAACAATAAGTTTTCCCCGTGTTTCCCCTCTAATGCTGTTTTCTTTTGACCA<br>AGCATGTCTGAATTCTAGAGAAGTCAGGAGGAACACACCCATTCTCGGTTTGA<br>AGGGACTGATGTTCTGAAGTACAACTGGGCACAGTCCCAGGCTCTTCAGGACG<br>CTTCCTCCATTCACACAGCGGGGATGTGATTGTTACAGCGGGTGGTGTGTGCT<br>GGCTGAGAAGCCACTGTGAATTGATTCTTCTTCTGAAGTTTATGTTTCTACTT<br>TTTGGAAATGAATAAATTACAGCCAGTCCATCAAGGAAA (SEQ ID NO: 147)<br><br>>NP_003028.1 signaling lymphocytic activation<br>molecule isoform b precursor [Homo sapiens]<br>MDPKGLLSLTFVLFLSLAFGASYGTGGRMMNCPKILRQLGSKVLLPLTYERIN<br>KSMNKSIHIVVTMAKSLENSVENKIVSLDPSEAGPPRYLGDRYKFYLENLTLG<br>IRESRKEDEGWYLMTLEKNVSVQRFCLQLRLYEQVSTPEIKVLNKTQENGTCT<br>LILGCTVEKGDHVAYSWSEKAGTHPLNPANSSHLLSLTLGPQHADNIYICTVS<br>NPISNNSQTFSPWPGCRTDPSETKPWAVYAGLLGGVIMILIMVVILQLRRRGK<br>TNHYQTTVEKKSLTIYAQVQKPGPLQKKLDSFPAQDPCTTIYVAATEPVPESV<br>QETNSITVYASVTLPES (SEQ ID NO: 148) |
| Mouse SLAM (CD150) | >NM_013730.4 Mus musculus signaling lymphocytic<br>activation molecule family member 1 (Slamf1),<br>transcript variant 1, mRNA<br>GAGCTTCTTCCTTGGGGGTAACAGTAAGCAGCTGTCCTGCCGAGCTGAGCTGA<br>GCTGAGCTCACAGCTGGGGACCCTGTCTGCGATTGCTGGCTAATGGATCCCAA<br>AGGATCCCTTTCCTGGAGAATACTTCTGTTTCTCTCCCTGGCTTTTGAGTTGA<br>GCTACGAACAGGTGGAGGTGTGATGGATTGCCCAGTGATTCTCCAGAAGCTG<br>GGACAGGACACGTGGCTGCCCCTGACGAATGAACATCAGATAAATAAGAGCGT<br>GAACAAAAGTGTCCGCATCCTCGTCACCATGGCGACGTCCCCAGGAAGCAAAT<br>CCAACAAGAAAATTGTGTCTTTTGATCTCTCTAAAGGGAGCTATCCAGATCAC<br>CTGGAGGATGGCTACCACTTTCAATCAAAAAACCTGAGCCTGAAGATCCTCGG<br>GAACAGGCGGGAGAGTGAAGGATGGTACTTGGTGAGCGTGGAGGAGAACGTTT<br>CTGTTCAGCAATTCTGCAAGCAGCTGAAGCTTTATGAACAGGTCTCCCCTCCA<br>GAGATTAAAGTGCTAAACAAAACCCAGGAGAACGAGAATGGGACCTGCAGCTT<br>GCTGTTGGCCTGCACAGTGAAGAAAGGGGACCATGTGACTTACAGCTGGAGTG<br>ATGAGGCAGGCACCCACCTGCTGAGCCGAGCCAACCGCTCCCACCTCCTGCAC<br>ATCACTCTTAGCAACCAGCATCAAGACAGCATCTACAACTGCACCGCAAGCAA<br>CCCTGTCAGCAGTATCTCTAGGACCTTCAACCTATCATCGCAAGCATGCAAGC<br>AGGAATCCTCCTCAGAATCGAGTCCATGGATGCAATATACTCTTGTACCACTG<br>GGGGTCGTTATAATCTTCATCCTGGTTTTCACGGCAATAATAATGATGAAAAG<br>ACAAGGTAAATCAAATCACTGCCAGCCACCAGTGGAAGAAAAAAAGCCTTACTA<br>TTTATGCCCAAGTACAGAAATCAGGGCCTCAAGAGAAGAAACTTCATGATGCC<br>CTAACAGATCAGGACCCCTGCACAACCATTTATGTGGCTGCCACAGAGCCTGC<br>CCCAGAGTCTGTCCAGGAACCAAACCCCACCACAGTTTATGCCAGTGTGACAC<br>TGCCAGAGAGCTGACCCATATACCCAGTGAAAGGACTTTTTGAAGGAGGATAG<br>AAGAACCAAATCCACACTGAACTGGACCCCGGGTCCCAAGTTCTCTGTGACA<br>GAAACTGCACATCTGTAACCTTCTCCAATCAGTTCCCTGGTGACGGATCTGCA<br>CAGGCGTGCTTATGAAGTAGATGAGAAGTGAGGCTTCCTGGGCATGCAACCTG<br>CTCTGCTGCTGACACAGATATGAAGCAGAGATCCCGTGGTACAGTGTACCATC<br>TTTGCTGTAGCAGATAATGTGGGTTTAGGCATCTCACTCTTTGCTGGACTGGA<br>TAACAGAACTCAAAAAAAAACCAACAAGCAAAGACATAGATCCCATCTCAGA<br>TGGCTGAGCACAAAGTATAAAAGCCATTTTGGCTCTCTGGACTTTATTCTGGA<br>AGCTGATCCTGATCACCTCAAGGCCAAGGGCTCCATGCCTCAGTTTCTCTCTC<br>ACCCTCTAGATGAAGAGGGAACAAAGCATAAAGAGTGAAATCCTTGTTGTCTG<br>AGATCATTCTATAAACGAACTGACATTTTATTTGCAAAACTCAAGCTAGTAAT<br>TCAGTAGACTTGAAGATGATTTTAGAGCCTCTTATGCTTCAAACAACAGAATG<br>AAATCCATCCAATGTTCTTCAAAGTGTGGTTCTCTGATTAAGTCAAAGCAACA<br>CTGTTTGGCAATGCTGCTGTAAAGTTGCCTGGAATACTCAGAGGAACTTGTCC<br>CAGGGAGGTTTTTTTCACTTCTTCAAAGAACTTTTGAATTTAAGTTCTCTGTT<br>TATTCCCTTGAGCAAAACTCTGGAACCTCAAGAGTCTCTCTCCGTTGGTTCTG<br>AGGCCATTTTATAGCCTAGGCCTCCTGTGGATCTACATGTGTATCACCCACTT<br>CCTATCTCACTGCATACCTCTGTGTAGTAGTAAATTTAACCTCAAGTAGAAAA<br>TTAAATTATTTTGGATGATCAGTTCCAAATGATTAGATGTTTAGTCTCTTATA<br>ATAGGATGTAGGTAGAGTCTATATAAAGTCCTATATTCTTCACGTTGTCTGTC<br>CTCAGAGAGACCATCTTTCAACCTATCTTCCTTCTTGCACAACTTTGGCAAAT<br>ACTTTAAAAATAACCATTGTGGAGATGGGGAGAGGTCTAAATGGATAATAGTA<br>CTTGCTTTGCAAACATGAAGATCTGGGTTCAAACTCCCAGTGTCCATGTAAAA<br>AGATAAGTGTGGTTGAGTGTGCCAGTAACATAGACACAGATAGGTCCTGAGAC<br>TTTGCTCCCTAGCCTTCCCAGCCAGGCATAAATGTCAAGTCCCCTGAGAGTGA<br>CAGAGGAAGATACTCCCCCCACACACACACACATACACGCACAGTGATACACA |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | TATACATGCATACAAAAAAAAAACTTATTGTAACAAAGAACACCAACTGCCTG<br>GCTCAAAACTCTCATGTCCCATTACTCTGTACCTTTCTGTATTTAGATAATTT<br>ACAGTGTGAGTTCTGOTGTTCCATGTATCCTATTTGTGTTACTAACTTATGTC<br>AAAGTATTTCTAATTATAATCAACAAAAGCTAACTTTG (SEQ ID NO: 149)<br><br>>NP_038758.2 signaling lymphocytic activation molecule isoform 1 precursor [*Mus musculus*]<br>MDPKGSLSWRILLFLSLAFELSYGTGGGVMDCPVILQKLGQDTWLPLTNEHQI<br>NKSVNKSVRILVTMATSPGSKSNKKIVSFDLSKGSYPDHLEDGYHFQSKNLSL<br>KILGNRRESEGWYLVSVEENVSVQQFCKQLKLYEQVSPPEIKVLNKTQENENG<br>TCSLLLACTVKKGDHVTYSWSDEAGTHLLSRANRSHLLHITLSNQHQDSIYNC<br>TASNPVSSISRTFNLSSQACKQESSSESSPWMQYTLVPLGVVIIFILVFTAII<br>MMKRQGKSNHCQPPVEEKSLTIYAQVQKSGPQEKKLHDALTQDDPCTTIYVAA<br>TEPAPESVQEPNPTTVYASVTLPES (SEQ ID NO: 150) |
| Human CD40 | >NM_001250.6 *Homo sapiens* CD40 molecule (CD40), transcript variant 1, mRNA<br>AGTGGTCCTGCCGCCTGGTCTCACCTCGCTATGGTTCGTCTGCCTCTGCAGTG<br>CGTCCTCTGGGGCTGCTTGCTGACCGCTGTCCATCCAGAACCACCCACTGCAT<br>GCAGAGAAAAACAGTACCTAATAAACAGTCAGTGTGTTCTTTGTGCCAGCCA<br>GGACAGAAACTGGTGAGTGACTGCACAGAGTTCACTGAAACGGAATGCCTTCC<br>TTGCGGTGAAAGCGAATTCCTAGACACCTGGAACAGAGAGACACACTGCCACC<br>AGCACAAATACTGCGACCCCAACCTAGGGCTTCGGGTCCAGCAGAAGGGCACC<br>TCAGAAACAGACACCATCTGCACCTGTGAAGAAGGCTGGCACTGTACGAGTGA<br>GGCCTGTGAGAGCTGTGTCCTGCACCGCTCATGCTCGCCCGGCTTTGGGGTCA<br>AGCAGATTGCTACAGGGGTTTCTGATACCATCTGCGAGCCCTGCCCAGTCGGC<br>TTCTTCTCCAATGTGTCATCTGCTTTCGAAAAATGTCACCCTTGGACAAGCTG<br>TGAGACCAAAGACCTGGTTGTGCAACAGGCAGGCACAAACAAGACTGATGTTG<br>TCTGTGGTCCCCAGGATCGGCTGAGAGCCCTGGTGGTGATCCCCATCATCTTC<br>GGGATCCTGTTTGCCATCCTCTTGGTGCTGGTCTTTATCAAAAAGGTGGCCAA<br>GAAGCCAACCAATAAGGCCCCCCACCCCAAGCAGGAACCCCAGGAGATCAATT<br>TTCCCGACGATCTTCCTGGCTCCAACACTGCTGCTCCAGTGCAGGAGACTTTA<br>CATGGATGCCAACCGGTCACCCAGGAGGATGGCAAAGAGAGTCGCATCTCAGT<br>GCAGGAGAGACAGTGAGGCTGCACCCACCCAGGAGTGTGGCCACGTGGGCAAA<br>CAGGCAGTTGGCCAGAGAGCCTGGTGCTGCTGCTGCTGTGGCGTGAGGGTGAG<br>GGGCTGGCACTGACTGGGCATAGCTCCCCGCTTCTGCCTGCACCCCTGCAGTT<br>TGAGACAGGAGACCTGGCACTGGATGCAGAAACAGTTCACCTTGAAGAACCTC<br>TCACTTCACCCTGGAGCCCATCCAGTCTCCCAACTTGTATTAAAGACAGAGGC<br>AGAAGTTTGGTGGTGGTGGTGTTGGGGTATGGTTTAGTAATATCCACCAGACC<br>TTCCGATCCAGCAGTTTGGTGCCCAGAGAGGCATCATGGTGGCTTCCCTGCGC<br>CCAGGAAGCCATATACACAGATGCCCATTGCAGCATTGTTTGTGATAGTGAAC<br>AACTGGAAGCTGCTTAACTGTCCATCAGCAGGAGACTGGCTAAATAAAATTAG<br>AATATATTTATACAACAGAATCTCAAAAACACTGTTGAGTAAGGAAAAAAAGG<br>CATGCTGCTGAATGATGGGTATGGAACTTTTTAAAAAAGTACATGCTTTTATG<br>TATGTATATTGCCTATGGATATATGTATAAATACAATATGCATCATATATTGA<br>TATAACAAGGGTTCTGGAAGGGTACACAGAAAACCCACAGCTCGAAGAGTGGT<br>GACGTCTGGGGTGGGGAAGAAGGGTCTGGGGGAGGGTTGGTTAAAGGGAGATT<br>TGGCTTTCCCATAATGCTTCATCATTTTTCCCAAAAGGAGAGTGAATTCACAT<br>AATGCTTATGTAATTAAAAAATCATCAAACATGTAAAAA (SEQ ID NO: 151)<br><br>>NP_001241.1 tumor necrosis factor receptor superfamily member 5 isoform 1 precursor [*Homo sapiens*]<br>MVRLPLQCVLWGCLLTAVHPEPPTACREKQYLINSQCCSLCQPGQKLVSDCTE<br>FTETECLPCGESEFLDTWNRETHCHQHKYCDPNLGLRVQQKGTSETDTICTCE<br>EGWHCTSEACESCVLHRSCSPGFGVKQIATGVSDTICEPCPVGFFSNVSSAFE<br>KCHPWTSCETKDLVVQQAGTNKTDVVCGPQDRLRALVVIPIIFGILFAILLVL<br>VFIKKVAKKPTNKAPHPKQEPQEINFPDDLPGSNTAAPVQETLHGCQPVTQED<br>GKESRISVQERQ (SEQ ID NO: 152) |
| Mouse CD40 | >NM_170703.2 *Mus musculus* CD40 antigen (Cd40), transcript variant 2, mRNA<br>AGCAGGGACTTTGGAGTGACTTGTGGCTTCAGCAGGAGCCCTGTGATTTGGCT<br>CTTCTGATCTCGCCCTGCGATGGTGTCTTTGCCTCGGCTGTGCGCGCTATGGG<br>GCTGCTTGTTGACAGCGGTCCATCTAGGGCAGTGTGTTACGTGCAGTGACAAA<br>CAGTACCTCCACGATGGCCAGTGCTGTGATTTGTGCCAGCCAGGAAGCCGACT<br>GACAAGCCACTGCACAGCTCTTGAGAAGACCCAATGCCACCCATGTGACTCAG<br>GCGAATTCTCAGCCAGTGGAACAGGGAGATTCGCTGTCACCAGCACAGACAC<br>TGTGAACCCAATCAAGGGCTTCGGGTTAAGAAGGAGGGCACCGCAGAATCAGA<br>CACTGTCTGTACCTGTAAGGAAGGACAACACTGCACCAGCAAGGATTGCGAGG<br>CATGTGCTCAGCACACGCCCTGTATCCCTGGCTTTGGAGTTATGGAGATGGCC<br>ACTGAGACCACTGATACCGTCTGTCATCCCTGCCCAGTCGGCTTCTTCTCCAA<br>TCAGTCATCACTTTTCGAAAAGTGTTATCCCTGGACAAGGTTTAAAGTCCCGG |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | ATGCGAGCCCTGCTGGTCATTCCTGTCGTGATGGGCATCCTCATCACCATTTT<br>CGGGGTGTTTCTCTATATCAAAAAGGTGGTCAAGAAACCAAAGGATAATGAGA<br>TCTTACCCCCTGCGGCTCGACGGCAAGATCCCCAGGAGATGGAAGATTATCCC<br>GGTCATAACACCGCTGCTCCAGTGCAGGAGACGCTGCACGGGTGTCAGCCTGT<br>CACACAGGAGGATGGTAAAGAGAGTCGCATCTCAGTGCAGGAGCGGCAGGTGA<br>CAGACAGCATAGCCTTGAGGCCCCTGGTCTGAACCCTGGAACTGCTTTGGAGG<br>CGATGGCTCGGCTCGGGAGCAGGGGCCTGGCTCTGAGGACTGCTTGCTGACCT<br>TTGAAGTTTGAGATGAGCCAAGACAGAGCCCAGTGCAGCTAACTCTCATGCCT<br>GCCCCCTATCATTTCTCAACTTGCTTTTTAAGGATGGAGGGAGAGCTCGGGCA<br>TCGGGGGTCCACAGTGATACCTACCAAGTGCAGCAGTGCAGGACCCAGAGTCG<br>TCTTGCTGCGGCGTTCACTGTAAGGAGTCATGGACACAGGAGTCCGTGGCCCA<br>CAGCTTGTGCTGTAGAGGGCACCTGGTTGCCCATCAGCAGGGTACTGGCTAA<br>ATAAATCTGTAATTATTTATACAATGACATCTCAGAAACTCTAGCAGGTGGGG<br>CAGAAAACAGGTAGTAGAATGATGGGTAGAGAAATAGCTTTTAAAACACATTC<br>CAAGGCAGGTAAGATGGCTTTTGTGAGTAAAGGAGCTTGCTGCCCAAACCCGG<br>TTACCTGATTTTGATCCCTGGGACTTCATGGTAAAAGGGAGAGAACCAAATCC<br>AGAGGGTTGTCATTTGACCTCCATGTGTGCTCTGTGGTAATGTACCCCGTGTG<br>TGCACATGTGCACATATCCTAAAATGGATGTGGTGGTGTATTGTAGAAATTAT<br>TTAATCCCGCCCTGGGGTTTCTACCTGTGTGTTACCATTTAGTTCTTGAATAA<br>AAGACACACTCAACCTTTATATTTACAATAA (SEQ ID NO: 153)<br><br>>NP_733804.1 tumor necrosis factor receptor<br>superfamily member 5 isoform 2 precursor [*Mus musculus*]<br>MVSLPRLCALWGCLLTAVHLGQCVTCSDKQYLHDGQCCDLCQPGSRLTSHCTA<br>LEKTQCHPCDSGEFSAQWNREIRCHQHRHCEPNQGLRVKKEGTAESDTVCTCK<br>EGQHCTSKDCEACAQHTPCIPGFGVMEMATETTDTVCHPCPVGFFSNQSSLFE<br>KCYPWTRFKVPDASPAGHSCRDGHPHHHFRGVSLYQKGGQETKG (SEQ ID NO: 154) |
| Human CD28 | >NM_006139.4 *Homo sapiens* CD28 molecule (CD28),<br>transcript variant 1, mRNA<br>ACACTTCGGGTTCCTCGGGGAGGAGGGGCTGGAACCCTAGCCCATCGTCAGGA<br>CAAAGATGCTCAGGCTGCTCTTGGCTCTCAACTTATTCCCTTCAATTCAAGTA<br>ACAGGAAACAAGATTTTGGTGAAGCAGTCGCCCATGCTTGTAGCGTACGACAA<br>TGCGGTCAACCTTAGCTGCAAGTATTCCTACAATCTCTTCTCAAGGGAGTTCC<br>GGGCATCCCTTCACAAAGGACTGGATAGTGCTGTGGAAGTCTGTGTTGTATAT<br>GGGAATTACTCCCAGCAGCTTCAGGTTTACTCAAAAACGGGGTTCAACTGTGA<br>TGGGAAATTGGGCAATGAATCAGTGACATTCTACCTCCAGAATTTGTATGTTA<br>ACCAAACAGATATTTACTTCTGCAAAATTGAAGTTATGTATCCTCCTCCTTAC<br>CTAGACAATGAGAAGAGCAATGGAACCATTATCCATGTGAAAGGGAAACACCT<br>TTGTCCAAGTCCCCTATTTCCCGGACCTTCTAAGCCCTTTTGGGTGCTGGTGG<br>TGGTTGGTGGAGTCCTGGCTTGCTATAGCTTGCTAGTAACAGTGGCCTTTATT<br>ATTTTCTGGGTGAGGAGTAAGAGGAGCAGGCTCCTGCACAGTGACTACATGAA<br>CATGACTCCCCGCCGCCCCGGGCCCACCCGCAAGCATTACCAGCCCTATGCCC<br>CACCACGCGACTTCGCAGCCTATCGCTCCTGACACGGACGCCTATCAGAAGC<br>CAGCCGGCTGGCAGCCCCCATCTGCTAATATCACTGCTCTGGATAGGAAATG<br>ACCGCCATCTCCAGCCGGCCACCTCAGGCCCCTGTTGGGCCACCAATGCCAAT<br>TTTTCTCGAGTGACTAGACCAAATATCAAGATCATTTTGAGACTCTGAAATGA<br>AGTAAAAGAGATTTCCTGTGACAGGCCAAGTCTTACAGTGCCATGGCCCACAT<br>TCCAACTTACCATGTACTTAGTGACTTGACTGAGAAGTTAGGGTAGAAAACAA<br>AAAGGGAGTGGATTCTGGGAGCCTCTTCCCTTTCTCACTCACCTGCACATCTC<br>AGTCAAGCAAAGTGTGGTATCCACAGACATTTTAGTTGCAGAAGAAAGGCTAG<br>GAAATCATTCCTTTTGGTTAAATGGGTGTTTAATCTTTTGGTTAGTGGGTTAA<br>ACGGGGTAAGTTAGAGTAGGGGGAGGGATAGGAAGACATATTTAAAAACCATT<br>AAAACACTGTCTCCCACTCATGAAATGAGCCACGTAGTTCCTATTTAATGCTG<br>TTTTCCTTTAGTTTAGAAATACATAGACATTGTCTTTTATGAATTCTGATCAT<br>ATTTAGTCATTTTGACCAAATGAGGGATTTGGTCAAATGAGGGATTCCCTCAA<br>AGCAATATCAGGTAAACCAAGTTGCTTTCCTCACTCCCTGTCATGAGACTTCA<br>GTGTTAATGTTCACAATATACTTTCGAAAGAATAAAATAGTTCTCCTACATGA<br>AGAAAGAATATGTCAGGAAATAAGGTCACTTTATGTCAAAATTATTTGAGTAC<br>TATGGGACCTGGCGCAGTGGCTCATGCTTGTAATCCCAGCACTTTGGGAGGCC<br>GAGGTGGGCAGATCACTTGAGATCAGGACCAGCCTGGTCAAGATGGTGAAACT<br>CCGTCTGTACTAAAAATACAAAATTTAGCTTGGCCTGGTGGCAGGCACCTGTA<br>ATCCCAGCTGCCCAAGAGGCTGAGGCATGAGAATCGCTTGAACCTGGCAGGCG<br>GAGGTTGCAGTGAGCCGAGATAGTGCCACAGCTCTCCAGCCTGGGCGACAGAG<br>TGAGACTCCATCTCAAACAACAACAACAACAACAACAACAACAAACCACA<br>AAATTATTTGAGTACTGTGAAGGATTATTTGTCTAACAGTTCATTCCAATCAG<br>ACCAGGTAGGAGCTTTCCTGTTTCATATGTTTCAGGGTTGCACAGTTGGTCTC<br>TTTAATGTCGGTGTGGAGATCCAAAGTGGGTTGTGGAAAGAGCGTCCATAGGA<br>GAAGTGAGAATACTGTGAAAAAGGGATGTTAGCATTCATTAGAGTATGAGGAT<br>GAGTCCCAAGAAGGTTCTTTGGAAGGAGGACGAATAGAATGGAGTAATGAAAT<br>TCTTGCCATGTGCTGAGGAGATAGCCAGCATTAGGTGACAATCTTCCAGAAGT<br>GGTCAGGCAGAAGGTGCCCTGGTGAGAGCTCCTTTACAGGGACTTTATGTGGT<br>TTAGGGCTCAGAGCTCCAAAACTCTGGGCTCAGCTGCTCCTGTACCTTGGAGG |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | TCCATTCACATGGGAAAGTATTTTGGAATGTGTCTTTTGAAGAGAGCATCAGA<br>GTTCTTAAGGGACTGGGTAAGGCCTGACCCTGAAATGACCATGGATATTTTC<br>TACCTACAGTTTGAGTCAACTAGAATATGCCTGGGGACCTTGAAGAATGGCCC<br>TTCAGTGGCCCTCACCATTTGTTCATGCTTCAGTTAATTCAGGTGTTGAAGGA<br>GCTTAGGTTTTAGAGGCACGTAGACTTGGTTCAAGTCTCGTTAGTAGTTGAAT<br>AGCCTCAGGCAAGTCACTGCCCACCTAAGATGATGGTTCTTCAACTATAAAT<br>GGAGATAATGGTTACAAATGTCTCTTCCTATAGTATAATCTCCATAAGGGCAT<br>GGCCCAAGTCTGTCTTTGACTCTGCCTATCCCTGACATTTAGTAGCATGCCCG<br>ACATACAATGTTAGCTATTGGTATTATTGCCATATAGATAAATTATGTATAAA<br>AATTAAACTGGGCAATAGCCTAAGAAGGGGGAATATTGTAACACAAATTTAA<br>ACCCACTACGCAGGGATGAGGTGCTATAATATGAGGACCTTTTAACTTCCATC<br>ATTTTCCTGTTTCTTGAAATAGTTTATCTTGTAATGAAATATAAGGCACCTCC<br>CACTTTTATGTATAGAAAGAGGTCTTTTAATTTTTTTTAATGTGAGAAGGAA<br>GGGAGGAGTAGGAATCTTGAGATTCCAGATCGAAAATACTGTACTTTGGTTGA<br>TTTTTAAGTGGGCTTCCATTCCATGGATTTAATCAGTCCCAAGAAGATCAAAC<br>TCAGCAGTACTTGGGTGCTGAAGAACTGTTGGATTTACCCTGGCACGTGTGCC<br>ACTTGCCAGCTTCTTGGGCACACAGAGTTCTTCAATCCAAGTTATCAGATTGT<br>ATTTGAAAATGACAGAGCTGGAGAGTTTTTTGAAATGGCAGTGGCAAATAAAT<br>AAATACTTTTTTTTAAATGGAAAGACTTGATCTATGGTAATAAATGATTTTGT<br>TTTCTGACTGGAAAAATAGGCCTACTAAAGATGAATCACACTTGAGATGTTTC<br>TTACTCACTCTGCACAGAAACAAAGAAGAAATGTTATACAGGGAAGTCCGTTT<br>TCACTATTAGTATGAACCAAGAAATGGTTCAAAAACAGTGGTAGGAGCAATGC<br>TTTCATAGTTTCAGATATGGTAGTTATGAAGAAAACAATGTCATTTGCTGCTA<br>TTATTGTAAGAGTCTTATAATTAATGGTACTCCTATAATTTTTGATTGTGAGC<br>TCACCTATTTGGGTTAAGCATGCCAATTTAAAGAGACCAAGTGTATGTACATT<br>ATGTTCTACATATTCAGTGATAAAATTACTAAACTACTATATGTCTGCTTTAA<br>ATTTGTACTTTAATATTGTCTTTTGGTATTAAGAAAGATATGCTTTCAGAATA<br>GATATGCTTCGCTTTGGCAAGGAATTTGGATAGAACTTGCTATTTAAAAGAGG<br>TGTGGGGTAAATCCTTGTATAAATCTCCAGTTTAGCCTTTTTTGAAAAAGCTA<br>GACTTTCAAATACTAATTTCACTTCAAGCAGGGTACGTTTCTGGTTTGTTTGC<br>TTGACTTCAGTCACAATTTCTTATCAGACCAATGGCTGACCTCTTTGAGATGT<br>CAGGCTAGGCTTACCTATGTGTTCTGTGTCATGTGAATGCTGAGAAGTTTGAC<br>AGAGATCCAACTTCAGCCTTGACCCCATCAGTCCCTCGGGTTAACTAACTGAG<br>CCACCGGTCCTCATGGCTATTTTAATGAGGGTATTGATGGTTAAATGCATGTC<br>TGATCCCTTATCCCAGCCATTTGCACTGCCAGCTGGGAACTATACCAGACCTG<br>GATACTGATCCCAAAGTGTTAAATTCAACTACATGCTGGAGATTAGAGATGGT<br>GCCAATAAAGGACCCAGAACCAGGATCTTGATTGCTATAGACTTATTAATAAT<br>CCAGGTCAAAGAGAGTGACACACACTCTCTCAAGACCTGGGGTGAGGGAGTCT<br>GTGTTATCTGCAAGGCATTTGAGGCTCAGAAAGTCTCTCTTTCCTATAGATA<br>TATGCATACTTTCTGACATATAGGAATGTATCAGGAATACTCAACCATCACAG<br>GCATGTTCCTACCTCAGGGCCTTTACATGTCCTGTTTACTCTGTCTAGAATGT<br>CCTTCTGTAGATGACCTGGCTTGCCTCGTCACCCTTCAGGTCCTTGCTCAAGT<br>GTCATCTTCTCCCCTAGTTAAACTACCCCACACCCTGTCTGCTTTCCTTGCTT<br>ATTTTTCTCCATAGCATTTTACCATCTCTTACATTAGACATTTTTCTTATTTA<br>TTTGTAGTTTATAAGCTTCATGAGGCAAGTAACTTTGCTTTGTTTCTTGCTGT<br>ATCTCCAGTGCCCAGAGCAGTGCCTGGTATATAATAAATATTTATTGACTGAG<br>TGAA (SEQ ID NO: 155)<br><br>>NP_006130.1 T-cell-specific surface glycoprotein<br>CD28 isoform 1 precursor [Homo sapiens]<br>MLRLLLALNLFPSIQVTGNKILVKQSPMLVAYDNAVNLSCKYSYNLFSREFRA<br>SLHKGLDSAVEVCVVYGNYSQQLQVYSKTGFNCDGKLGNESVTFYLQNLYVNQ<br>TDIYFCKIEVMYPPPYLDNEKSNGTIIHVKGKHLCPSPLFPGPSKPFWVLVVV<br>GGVLACYSLLVTVAFIIFWVRSKRSRLLHSDYMNMTPRRPGPTRKHYQPYAPP<br>RDFAAYRS (SEQ ID NO: 156) |
| Mouse CD28 | >NM_007642.4 Mus musculus CD28 antigen (Cd28), mRNA<br>AGACCTTGGCAGATGTGACTTCAGTTCACACCACACTCTGCCTTGCTCACAGA<br>GGAGGGGCTGCAGCCCTGGCCCTCATCAGAACAATGACACTCAGGCTGCTGTT<br>CTTGGCTCTCAACTTCTTCTCAGTTCAAGTAACAGAAAACAAGATTTTGGTAA<br>AGCAGTCGCCCCTGCTTGTGGTAGATAGCAACGAGGTCAGCCTCAGCTGCAGG<br>TATTCCTACAACCTTCTCGCAAAGGAATTCCGGGCATCCCTGTACAAGGGCGT<br>GAACAGCGACGTGGAAGTCTGTGTCGGGAATGGGAATTTTACCTATCAGCCCC<br>AGTTTCGCTCGAATGCCGAGTTCAACTGCGACGGGGATTTCGACAACGAAACA<br>GTGACGTTCCGTCTCTGGAATCTGCACGTCAATCACACAGATATTTACTTCTG<br>CAAAATTGAGTTCATGTACCCTCCGCCTTACCTAGACAACGAGAGGAGCAATG<br>GAACTATTATTCACATAAAAGAGAAACATCTTTGTCATACTCAGTCATCTCCT<br>AAGCTGTTTTGGGCACTGGTCGTGGTTGCTGGAGTCCTGTTTTGTTATGGCTT<br>GCTAGTGACAGTGGCTCTTTGTGTTATCTGGACAAATAGTAGAAGGAACAGAC<br>TCCTTCAAAGTGACTACATGAACATGACTCCCCGGAGGCCTGGGCTCACTCGA<br>AAGCCTTACCAGCCCTACGCCCCTGCCAGAGACTTTGCAGCGTACCGCCCCTG<br>ACAGGGACCCCTATCCAGAAGCCCGCCGGCTGGTACCCGTCACCTGCTCATC<br>ATCACTGCTCTGGATAGGAAAGGACAGCCTCATCTTCAGCCGGCCACTTTGGA<br>CCTCTACTGGGCCACCAATGCCAACTATTTTAGAGTGTCTAGATCTAACATCA<br>TGATCATCTTGAGACTCTGGAATGAATGACAGAAGCTTCTATGGCAGGATAAA |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | GTCTGTGTGGCTTGACCCAAACTCAAGCTTAATACATTTATTGACTTGATTGG<br>GGAAGTTAGAGTAGAGCAATCAAAAAGATCATTCATTCAGCCTTGGGAAGTCA<br>ATTTGCAGGCTCCTGGATGAGCCCTGCCCCGTTTTCACTTGCCAGCACATTTC<br>AGTCATGTGGTGTGATAGCCAAAGATGTTTTGGACAGAGAAGAAAGGATAGAA<br>AAACCTTCTCTTTGGCTAAGTTGGTGTTTGGGGTGGGGATAGGTTAGAGTATA<br>GTACTTAACTATTTGAAAATAATGAAAACACTTTTTTCACTCATGAAATGAG<br>CCACTTAGCTCCTAAATAGTGTTTTCCTGTTAGTTTAGAAAGTTGTGGACATA<br>TTTTTTTAATGATTTCTGACCATTTTTAATCACATTGACTCATGGAATGGCCT<br>CAAAGCACCCCCAGTGCTTCTTTCCTCATTCCCGGTCATGGGAACTCAGTAT<br>TATTAATAGTCACAACATGATTTCAGAACTAGATAGCCCTCCCACACCAAGAA<br>GAATGTGAGAGGAAGTAAGGTCACTTTATGTAAAAAAAAAAAAAACAAACGC<br>GTACACATATGTATGTATACATACCTATGTGCACACACACACACATATA<br>CATACACACAAAATGCTATGAAGAGTTATCTGTTTAGTAGCCTGTTATAGTCA<br>AATCATTTTAAGTTTCAACTTCTTACAGTTGGGCCACTTGTTGTCCTTTGTGG<br>ATGGATATCTGAAATTGTGTCTATATATTGCTAGTCATGATACTGTGAACAAA<br>AAGGGTAGTGTTAGTATTTGTCAGGGTGGTAAGGATGCATTCCAGGAAGCTTC<br>CTCTGAGGAAGGGAATGAGGTCATTCTTGCCATGTATGAAAGACATAGATGTT<br>TTCCAGAAGGCACCATTGGGAGCCCCAGTATAAGTTCCTTTAGACTCTACAGT<br>TTAGAGGGATTTTATATGTCCTAGGACTCAGGACTCCAGAACTTTGTGGGCTC<br>AGCTGCTTCATACCATGGGGATACATTGACATGAACAATTATTTTGGAATGTG<br>TCTTTAGGGACGACATCAAAGTTCTCAAGTACCTACAAGACCTGATACTGGAA<br>TGAAGGTGGACTTTCTTTTTTGCTTCCAGTTCGGATCAACTGGAATGTATCTG<br>GGGACCTTGAAGAACGGCTGTCCAGCTGTCTTCACCATTTGTATAGTGCTTTG<br>AATTATTCAGAGGTTTTAAAGTCAGGAAGACCTGGTTTAAAAAACATTTCATT<br>ATGAGTTAAATGGCCTCAGGCAAGTCACTGTTCATCCAAGTCTATGACTCCTC<br>AACTGTAAGATGGCCACACTGAAACTTGCTAAGATCCTCTGGCCTCTGCCTCC<br>CAAGAGTTGGGATTTCAGGAGTGCACAATCATGACCCAAACTCGTGATAATCT<br>CTCAGCTTCAATAACTTTCCAGCTAATTGGAATATCCTGTAATCAAACATGAG<br>GCATTTCCCCTCCCCCCACTGTTTTTGTGTATAAAGAGATCTTTAAACTTTTT<br>TTTTAATATGAGGGGTAAGAAAAGATAGGAATCTTTTAATTCTAGACAGAAGA<br>TATTGTGCTTTGGTTTTTTTTTTTAATGGCTTCTATTCTGTGCTTTTAAT<br>TAAACCAGAGAAGGCCAAGATTAGCCCTACTTGTGTGATAAAAGAATGCTGGC<br>CCTTGTGATTGCAGTCAGCCTCTTGACACATAGAGTTCTTGAATCTAAGTTAT<br>AAAATTATATTTGAAATGACAGAGCTGGAGAATTTATAGAAAGGGTCATAGC<br>AAATAACAAACCATTTTTTTTAAACGGAAAGATTTGGTCTTTGGCAATCAAT<br>AACTTTGTTTTCTAACTGGAAAAGGAGGTTTACTGGAGATGAATCACACCTGA<br>AAGTTTTCATACCTCCTCTGAACACAACCGAAACATAGGTGTCCAAAGCCTTT<br>CGCTCTCGGTATGAACCAACAGGCGGGTTAAAAACACTGGGTCAGAGTAAAGC<br>TTTTGCAGTTTCAGATGTAGTGTGTATGAAGAAAACTATGTCACTTGCTGCTA<br>TTATTGTAAGAGTCTAAGAACTAAAGGTGTGCCTGTAATTTCTAATTATGAGC<br>TCACCTATTTGGTACCGAGCATGCCAATTTTAAAGAGACCCGGTGTACCTTAT<br>AGCTACATCCAATGATAAAATTACCACACTAGCACATGCCTGTGTTTAAACTC<br>GTGCTTTAATGTTTTCTTAGGGCAGGTATGCACCCCCTTTGCAGTGAGTTGG<br>GAGAGATTTTGAAAAAGTGTATGACAAACATTTTTAACACCTTTGGTTTCCTC<br>TCTCTGTGTCTCTTTGTCTCTGTCTCTCTTTCTCTCCTGTGCATATGTCTC<br>CCCTCCCTCACTTCTCTGTCTCTTCCTCTCTCCCTCTCTCTGTCTTTCTCTGT<br>GTGTCTCTCTGTCTCTGTATCTCTCTGTCTGTCTCTTTCTCTGCAGATTTT<br>CAAAACGTTGTTTTTCTATGGAAGAAATACAAGCTGTGGTTGGTTTGCTACGA<br>GTCAGTAGCAGTTTATCAGTAGGCCAATGTTTTATCTCTTGGAGATTTCAGTC<br>TGGGTTTACCCAATGTATTCTCTGTAATGTGACTGCTGGGGACAGATATAACT<br>TGATTGAGCCTTCAAATCATTTAGGTCTTCAATCATTTAGTCAACGGAGTGAG<br>CCACTAATCTGCAATGGCTATTTTAATATGCATACTGATGGTCAAATGGATGT<br>CTGATCTCTCATCCCAGCTTTCTGTACTACCATATGGGAACTATATGTAACTT<br>GTATACTTACCTGAATATGTTAAATTCAACTACATGGTAAGATGGACCAGAAA<br>TTGCAATGTTCATGTCCATATAGCCACCATTAACCCAAGTTAAGCACAGTAGT<br>GTGGGTTCTCTCAGGACTTGTGAATGAGTTTATGCTCTCTACAAAGACAGGTG<br>AAGCTTAAATCTCTCTTGCACTGCTATGTTTATGCAAATATCAAGATTGTTTC<br>TGTACCAGGGACTTAACACATTCTATTCATACTATTTTCCCTGTCTACAATGT<br>TATTTCATAGATATCTACTTGGTTTGCTCTTACTTCCTTGACATATTTGCCCA<br>AATGCCACCTTCAACTGTAGTTAATTACCTGTACAACCTGTCTCCATGCCTTG<br>TTTTATTTTCTCTATAACTCTACTAATAGGTATTTTTCTTATTTATTGGTTTA<br>TTGCCTGTTTTTTTTCCTAAATCTACACCGGATCTCCAAAGGGAAAGAACTCC<br>ATTTGCTTTGATTTTATTGCTGTATCCCCAGTGCCTAGAATAATGCTTAGCCT<br>GCAATAAATATTTATTCATTGACT (SEQ ID NO: 157)<br><br>>NP_031668.3 T-cell-specific surface glycoprotein<br>CD28 precursor [*Mus musculus*]<br>MTLRLLFLALNFFSVQVTENKILVKQSPLLVVDSNEVSLSCRYSYNLLAKEFR<br>ASLYKGVNSDVEVCVGNGNFTYQPQFRSNAEFNCDGDFDNETVTFRLWNLHVN<br>HTDIYFCKIEFMYPPPYLDNERSNGTIIHIKEKHLCHTQSSPKLFWALVVVAG<br>VLFCYGLLVTVALCVIWTNSRRNRLLQSDYMNMTPRRPGLTRKPYQPYAPARD<br>FAAYRP (SEQ ID NO: 158) |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| Human CD28H | >NM_144615.2 *Homo sapiens* transmembrane and immunoglobulin domain containing 2 (TMIGD2), transcript variant 1, mRNA<br>GGAAGTCTGTCAACTGGGAGGGGGAGAGGGGGGTGATGGGCCAGGAATGGGGT<br>CCCCGGGCATGGTGCTGGGCCTCCTGGTGCAGATCTGGGCCCTGCAAGAAGCC<br>TCAAGCCTGAGCGTGCAGCAGGGGCCCAACTTGCTGCAGGTGAGGCAGGGCAG<br>TCAGGCGACCCTGGTCTGCCAGGTGGACCAGGCCACAGCCTGGGAACGGCTCC<br>GTGTTAAGTGGACAAAGGATGGGGCCATCCTGTGTCAACCGTACATCACCAAC<br>GGCAGCCTCAGCCTGGGGGTCTGCGGGCCCCAGGGACGGCTCTCCTGGCAGGC<br>ACCCAGCCATCTCACCCTGCAGCTGGACCCTGTGAGCCTCAACCACAGCGGGG<br>CGTACGTGTGCTGGGCGGCCGTAGAGATTCCTGAGTTGGAGGAGGCTGAGGGC<br>AACATAACAAGGCTCTTTGTGGACCCAGATGACCCCACACAGAACAGAAACCG<br>GATCGCAAGCTTCCCAGGATTCCTCTTCGTGCTGCTGGGGGTGGGAAGCATGG<br>GTGTGGCTGCGATCGTGTGGGGTGCCTGGTTCTGGGGCCGCCGCAGCTGCCAG<br>CAAAGGGACTCAGGTAACAGCCCAGGAAATGCATTCTACAGCAACGTCCTATA<br>CCGGCCCCGGGGGGCCCCAAAGAAGAGTGAGGACTGCTCTGGAGAGGGGAAGG<br>ACCAGAGGGGCCAGAGCATTTATTCAACCTCCTTCCCGCAACCGGCCCCCCGC<br>CAGCCGCACCTGGCGTCAAGACCCTGCCCCAGCCCGAGACCCTGCCCCAGCCC<br>CAGGCCCGGCCACCCCGTCTCTATGGTCAGGGTCTCTCCTAGACCAAGCCCCA<br>CCCAGCAGCCGAGGCCAAAAGGGGTTCCCCAAAGTGGGAGAGGAGTGAGAGATC<br>CCAGGAGACCTCAACAGGACCCCACCCATAGGTACACACAAAAAAGGGGGGAT<br>CGAGGCCAGACACGGTGGCTCACGCCTGTAATCCCAGCAGTTTGGGAAGCCGA<br>GGCGGGTGGAACACTTGAGGTCAGGGGTTTGAGACCAGCCTGGCTTGAACCTG<br>GGAGGCGGAGGTTGCAGTGAGCCGAGATTGCGCCACTGCACTCCAGCCTGGGC<br>GACAGAGTGAGACTCCGTCTCAAAAAAAACAAAAAGCAGGAGGATTGGGAGCC<br>TGTCAGCCCCATCCTGAGACCCCGTCCTCATTTCTGTAATGATGGATCTCGCT<br>CCCACTTTCCCCCAAGAACCTAATAAAGGCTTGTGAAGAAAAGCAAAAAAAA<br>AAAAAAAAAA (SEQ ID NO: 159)<br><br>>NP_653216.2 transmembrane and immunoglobulin domain-containing protein 2 isoform 1 precursor [*Homo sapiens*]<br>MGSPGMVLGLLVQIWALQEASSLSVQQGPNLLQVRQGSQATLVCQVDQATAWE<br>RLRVKWTKDGAILCQPYITNGSLSLGVCGPQGRLSWQAPSHLTLQLDPVSLNH<br>SGAYVCWAAVEIPELEEAEGNITRLFVDPDDPTQNRNRIASFPGFLFVLLGVG<br>SMGVAAIVWGAWFWGRRSCQQRDSGNSPGNAFYSNVLYRPRGAPKKSEDCSGE<br>GKDQRGQSIYSTSFPQPAPRQPHLASRPCPSPRPCPSPRPGHPVSMVRVSPRP<br>SPTQQPRPKGFPKVGEE (SEQ ID NO: 160) |
| Human CD2 | >NM_001328609.2 *Homo sapiens* CD2 molecule (CD2), transcript variant 1, mRNA<br>AGTCTCACTTCAGTTCCTTTTGCATGAAGAGCTCAGAATCAAAAGAGGAAACC<br>AACCCCTAAGATGAGCTTTCCATGTAAATTTGTAGCCAGCTTCCTTCTGATTT<br>TCAATGTTTCTTCCAAAGGTGCAGTCTCCAAAGAGATTACGAATGCCTTGGAA<br>ACCTGGGGTGCCTTGGGTCAGGACATCAACTTGGACATTCCTAGTTTTCAAAT<br>GAGTGATGATATTGACGATATAAAATGGGAAAAAACTTCAGACAAGAAAAGA<br>TTGCACAATTCAGAAAAGAGAAAGAGACTTTCAAGGAAAAAGATACATATAAG<br>CTATTTAAAAATGGAACTCTGAAAATTAAGCATCTGAAGACCGATGATCAGGA<br>TATCTACAAGGTATCAATATATGATACAAAAGGAAAAAATGTGTTGAAAAAA<br>TATTTGATTTGAAGATTCAAGAGAGGGTCTCAAAACCAAAGATCTCCTGGACT<br>TGTATCAACACAACCCTGACCTGTGAGGTAATGAATGGAACTGACCCCGAATT<br>AAACCTGTATCAAGATGGGAAACATCTAAAACTTTCTCAGAGGGTCATCACAC<br>ACAAGTGGACCACCAGCCTGAGTGCAAAATTCAAGTGCACAGCAGGGAACAAA<br>GTCAGCAAGGAATCCAGTGTCGAGCCTGTCAGCTGTCCAGGAGGCAGCATCCT<br>TGGCCAGAGTAATGGGCTCTCTGCCTGGACCCCTCCCAGCCATCCCACTTCTC<br>TTCCTTTTGCAGAGAAAGGTCTGGACATCTATCTCATCATTGGCATATGTGGA<br>GGAGGCAGCCTCTTGATGGTCTTTGTGGCACTGCTCGTTTTCTATATCACCAA<br>AAGGAAAAAACAGAGGAGTCGGAGAAATGATGAGGAGCTGGAGACAAGAGCCC<br>ACAGAGTAGCTACTGAAGAAAGGGGCCGGAAGCCCCACCAAATTCCAGCTTCA<br>ACCCCTCAGAATCCAGCAACTTCCCAACATCCTCCTCCACCACCTGGTCATCG<br>TTCCCAGGCACCTAGTCATCGTCCCCGCCTCCTGGACACCGTGTTCAGCACC<br>AGCCTCAGAAGAGGCCTCCTGCTCCGTCGGGCACACAAGTTCACCAGCAGAAA<br>GGCCCGCCCCTCCCCAGACCTGAGTTCAGCCAAAACCTCCCCATGGGGCAGC<br>AGAAAACTCATTGTCCCCTTCCTCTAATTAAAAAAGATAGAAACTGTCTTTTT<br>CAATAAAAAGCACTGTGGATTTCTGCCCTCCTGATGTGCATATCCGTACTTCC<br>ATGAGGTGTTTTCTGTGTGCAGAACATTGTCACCTCCTGAGGCTGTGGGCCAC<br>AGCCACCTCTGCATCTTCGAACTCAGCCATGTGGTCAACATCTGGAGTTTTG<br>GTCTCCTCAGAGAGCTCCATCACACCAGTAAGGAGAAGCAATATAAGTGTGAT<br>TGCAAGAATGGTAGAGGACCGAGCACAGAAATCTTAGAGATTTCTTGTCCCCT<br>CTCAGGTCATGTGTAGATGCGATAAATCAAGTGATTGGTGTGCCTGGGTCTCA<br>CTACAAGCAGCCTATCTGCTTAAGAGACTCTGGAGTTTCTTATGTGCCCTGGT<br>GGACACTTGCCCACCATCCTGTGAGTAAAAGTGAAATAAAAGCTTTGACTAGA<br>(SEQ ID NO: 161) |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | >NP_001315538.1 T-cell surface antigen CD2 isoform 1 precursor [Homo sapiens]<br>MSFPCKFVASPLLIFNVSSKGAVSKEITNALETWGALGQDINLDIPSFQMSDD<br>IDDIKWEKTSDKKKIAQFRKEKETFKEKDTYKLFKNGTLKIKHLKTDDQDIYK<br>VSIYDTKGKNVLEKIFDLKIQERVSKPKISWTCINTTLTCEVMNGTDPELNLY<br>QDGKHLKLSQRVITHKWTTSLSAKFKCTAGNKVSKESSVEPVSCPGGSILGQS<br>NGLSAWTPPSHPTSLPFAEKGLDIYLIIGICGGGSLLMVFVALLVFYITKRKK<br>QRSRRNDEELETRAHRVATEERGRKPHQIPASTPQNPATSQHPPPPPGHRSQA<br>PSHRPPPPGHRVQHQPQKRPPAPSGTQVHQQKGPPLPRPRVQPKPPHGAAENS<br>LSPSSN (SEQ ID NO: 162) |
| Mouse CD2 | >NM_013486.2 Mus musculus CD2 antigen (Cd2), mRNA<br>GCCTCACCACAGTCCTGACAGAAAGAACTCAGAGTCACCCCTGGGAAAAGAAC<br>TCTAAAGATGAAATGTAAATTCCTGGGTAGCTTCTTTCTGCTCTTCAGCCTTT<br>CCGGCAAAGGGGCGGACTGCAGAGACAATGAGACCATCTGGGGTGTCTTGGGT<br>CATGGCATCACCCTGAACATCCCCAACTTTCAAATGACTGATGATATTGATGA<br>GGTGCGATGGGTAAGGAGGGGCACCCTGGTCGCAGAGTTTAAAAGGAAGAAGC<br>CACCTTTTTTGATATCAGAAACGTATGAGGTCTTAGCAAACGGATCCCTGAAG<br>ATAAAGAAGCCGATGATGAGAAACGACAGTGGCACCTATAATGTAATGGTGTA<br>TGGCACAAATGGGATGACTAGGCTGGAGAAGGACCTGGACGTGAGGATTCTGG<br>AGAGGGTCTCAAAGCCCATGATCCACTGGGAATGCCCCAACACAACCCTGACC<br>TGTGCGGTCTTGCAAGGGACAGATTTTGAACTGAAGCTGTATCAAGGGGAAAC<br>ACTACTCAATAGTCTCCCCCAGAAGAACATGAGTTACCAGTGGACCAACCTGA<br>ACGCACCATTCAAGTGTGAGGCGATAAACCCGGTCAGCAAGGAGTCTAAGATG<br>GAAGTTGTTAACTGTCCAGAGAAAGGTCTGTCCTTCTATGTCACAGTGGGGGT<br>CGGTGCAGGAGGACTCCTCTTGGTGCTCTTGGTGGCGCTTTTTATTTTCTGTA<br>TCTGCAAGAGGAGAAAACGGAACAGGAGGAGAAAAGATGAAGAGCTGGAAATA<br>AAAGCTTCCAGAACAAGCACTGTGGAAAGGGGCCCCAAGCCGCACTCAACCCC<br>AGCCGCAGCAGCGCAGAATTCAGTGGCGCTCCAAGCTCCTCCTCCACCTGGCC<br>ATCACCTCCAGACACCTGGCCATCGTCCCTTGCCTCCAGGCCACCGTACCCGT<br>GAGCACCAGCAGAAGAAGAGACCTCCTCCATCAGGCACACAGATTCACCAGCA<br>GAAAGGCCCTCCTTTACCCAGACCCCGAGTTCAGCCAAAACCTCCCTGTGGGA<br>GTGGAGATGGTGTTTCACTGCCGCCCCTAATTAAGAAGGCAGAGTTCGTCAT<br>TTCCAATAAAAAGCTGTGTGGATTTATCTTC (SEQ ID NO: 163)<br><br>>NP_038514.1 T-cell surface antigen CD2 precursor [Mus musculus]<br>MKCKFLGSFFLLFSLSGKGADCRDNETIWGVLGHGITLNIPNFQMTDDIDEVR<br>WVRRGTLVAEFKRKKPPFLISETYEVLANGSLKIKKPMMRNDSGTYNVMVYGT<br>NGMTRLEKDLDVRILERVSKPMIHWECPNTTLTCAVLQGTDFELKLYQGETLL<br>NSLPQKNMSYQWTNLNAPFKCEAINPVSKESKMEVVNCPEKGLSFYVTVGVGA<br>GGLLLVLLVALFIFCICKRRKRNRRRKDEELEIKASRTSTVERGPKPHSTPAA<br>AAQNSVALQAPPPPGHHLQTPGHRPLPPGHRTREHQQKKRPPPSGTQIHQQKG<br>PPLPRPRVQPKPPCGSGDGVSLPPPN (SEQ ID NO: 164) |
| Human LFA-3 (CD58) | >NM_001779.3 Homo sapiens CD58 molecule (CD58), transcript variant 1, mRNA<br>GAACTTAGGGCTGCTTGTGGCTGGGCACTCGCGCAGAGGCCGGCCCGACGAGC<br>CATGGTTGCTGGGAGCGACGCGGGCGGGCCCTGGGGGTCCTCAGCGTGGTCT<br>GCCTGCTGCACTGCTTTGGTTTCATCAGCTGTTTTTCCCAACAAATATATGGT<br>GTTGTGTATGGGAATGTAACTTTCCATGTACCAAGCAATGTGCCTTTAAAAGA<br>GGTCCTATGGAAAAAACAAAAGGATAAAGTTCAGAACTGGAAAATTCTGAAT<br>TCAGAGCTTTCTCATCTTTTAAAAATAGGGTTTATTTAGACACTGTGTCAGGT<br>AGCCTCACTATCTACAACTTAACATCATCAGATGAAGATGAGTATGAAATGGA<br>ATCGCCAAATATTACTGATACCATGAAGTTCTTTCTTTATGTGCTTGAGTCTC<br>TTCCATCTCCCACACTAACTTGTGCATTGACTAATGGAAGCATTGAAGTCCAA<br>TGCATGATACCAGAGCATTACAACAGCCATCGAGGACTTATAATGTACTCATG<br>GGATTGTCCTATGGAGCAATGTAAACGTAACTCAACCAGTATATATTTTAAGA<br>TGGAAAATGATCTTCCACAAAAAATACAGTGTACTCTTAGCAATCCATTATTT<br>AATACAACATCATCAATCATTTTGACAACCTGTATCCCAAGCAGCGGTCATTC<br>AAGCACAGATATGCACTTATACCCATACCATTAGCAGTAATTACAACATGTA<br>TTGTGCTGTATATGAATGGTATTCTGAAATGTGACAGAAAACCAGACAGAACC<br>AACTCCAATTGATTGGTAACAGAAGATGAAGACAACAGCATAACTAAATTATT<br>TTAAAAACTAAAAAGCCATCTGATTTCTCATTTGAGTATTACAATTTTTGAAC<br>AACTGTTGGAAATGTAACTTGAAGCAGCTGCTTTAAGAAGAAATACCCACTAA<br>CAAAGAACAAGCATTAGTTTTGGCTGTCATCAACTTATTATATGACTAGGTGC<br>TTGCTTTTTTTGTCAGTAAATTGTTTTTACTGATGATGTAGATACTTTTGTAA<br>ATAAATGTAAATATGTACACAAGTGA (SEQ ID NO: 165) |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | >NP_001770.1 lymphocyte function-associated antigen 3 isoform 1 [Homo sapiens]<br>MVAGSDAGRALGVLSVVCLLHCFGFISCFSQQIYGVVYGNVTFHVPSNVPLKE<br>VLWKKQKDKVAELENSEFRAFSSFKNRVYLDTVSGSLTIYNLTSSDEDEYEME<br>SPNITDTMKFFLYVLESLPSPTLTCALTNGSIEVQCMIPEHYNSHRGLIMYSW<br>DCPMEQCKRNSTSIYFKMENDLPQKIQCTLSNPLFNTTSSIILTTCIPSSGHS<br>RHRYALIPIPLAVITTCIVLYMNGILKCDRKPDRTNSN (SEQ ID NO: 166) |
| Human CD48 | >NM_001778.4 Homo sapiens CD48 molecule (CD48), transcript variant 1, mRNA<br>CTTTTTCTAGCCAGGCTCTCAACTGTCTCCTGCGTTGCTGGGAAGTTCTGGAA<br>GGAAGCATGTGCTCCAGAGGTTGGGATTCGTGTCTGGCTCTGGAATTGCTACT<br>GCTGCCTCTGTCACTCCTGGTGACCAGCATTCAAGGTCACTTGGTACATATGA<br>CCGTGGTCTCCGGCAGCAACGTGACTCTGAACATCTCTGAGAGCCTGCCTGAG<br>AACTACAAACAACTAACCTGGTTTTATACTTTCGACCAGAAGATTGTAGAATG<br>GGATTCCAGAAAATCTAAGTACTTTGAATCCAAATTTAAAGGCAGGGTCAGAC<br>TTGATCCTCAGAGTGGCGCACTGTACATCTCTAAGGTCCAGAAAGAGGACAAC<br>AGCACCTACATCATGAGGGTGTTGAAAAAGACTGGGAATGAGCAAGAATGGAA<br>GATCAAGCTGCAAGTGCTTGACCCTGTACCCAAGCCTGTCATCAAAATTGAGA<br>AGATAGAAGACATGGATGACAACTGTTATCTGAAACTGTCATGTGTGATACCT<br>GGCGAGTCTGTAAACTACACCTGGTATGGGACAAAAGGCCCTTCCCAAAGGA<br>GCTCCAGAACAGTGTGCTTGAAACCACCCTTATGCCACATAATTACTCCAGGT<br>GTTATACTTGCCAAGTCAGCAATTCTGTGAGCAGCAAGAATGGCACGGTCTGC<br>CTCAGTCCACCCTGTACCCTGGCCCGGTCCTTTGGAGTAGAATGGATTGCAAG<br>TTGGCTAGTGGTCACGGTGCCCACCATTCTTGGCCTGTTACTTACCTGAGATG<br>AGCTCTTTTAACTCAAGCGAAACTTCAAGGCCAGAAGATCTTGCCTGTTGGTG<br>ATCATGCTCCTCACCAGGACAGAGACTGTATAGGCTGACCAGAAGCATGCTGC<br>TGAATTATCAACGAGGATTTTCAAGTTAACTTTTAAATACTGGTTATTATTTA<br>ATTTTATATCCCTTTGTTGTTTTCTAGTACACAGAGATATAGAGATACACATG<br>CTTTTTTCCCACCCAAAATTGTGACAACATTATGTGAATGTTTTATTATTTTT<br>TAAAATAAACATTTGATATAATTGTCAATTAACTGAA (SEQ ID NO: 167)<br><br>>NP_001769.2 CD48 antigen isoform 1 precursor [Homo sapiens]<br>MCSRGWDSCLALELLLLPLSLLVTSIQGHLVHMTVVSGSNVTLNISESLPENY<br>KQLTWFYTFDQKIVEWDSRKSKYFESKFKGRVRLDPQSGALYISKVQKEDNST<br>YIMRVLKKTGNEQEWKIKLQVLDPVPKPVIKIEKIEDMDDNCYLKLSCVIPGE<br>SVNYTWYGDKRPFPKELQNSVLETTLMPHNYSRCYTCQVSNSVSSKNGTVCLS<br>PPCTLARSFGVEWIASWLVVTVPTILGLLLT (SEQ ID NO: 168) |
| Mouse CD48 | >NM_007649.5 Mus musculus CD48 antigen (Cd48), transcript variant 1, mRNA<br>ATACGACTTCCGGTTTTGGGTTTTGCTTCCTGATTGAAGGGCAGGCGCCCTGA<br>CTTCTCTTACAGTTGTCTCCAGTGTTCTGGGGAAGCTTCTCTAAGTATTATGT<br>GCTTCATAAAACAGGGATGGTGTCTGGTCCTGGAACTGCTACTGCTGCCCTTG<br>GGAACTGGATTTCAAGGTCATTCAATACCAGATATAAATGCCACCACCGGCAG<br>CAATGTAACCCTGAAAATCCATAAGGACCCACTTGGACCATATAAACGTATCA<br>CCTGGCTTCATACTAAAAATCAGAAGATTTTAGAGTACAACTATAATAGTACA<br>AAGACAATCTTCGAGTCTGAATTTAAAGGCAGGGTTTATCTTGAAGAAAACAA<br>TGGTGCACTTCATATCTCTAATGTCCGGAAAGAGGACAAAGGTACCTACTACA<br>TGAGAGTGCTGCGTGAAACTGAGAACGAGTTGAAGATAACCCTGGAAGTATTT<br>GATCCTGTGCCCAAGCCTTCCATAGAAATCAATAAGACTGAAGCGTCGACTGA<br>TTCCTGTCACCTGAGGCTATCGTGTGAGGTAAAGGACCAGCATGTTGACTATA<br>CTTGGTATGAGAGCTCGGGACCTTTCCCCAAAAAGAGTCCAGGATATGTGCTC<br>GATCTCATCGTCACACCACAGAACAAGTCTACATTTTACACCTGCCAAGTCAG<br>CAATCCTGTAAGCAGCAAGAACGACACAGTGTACTTCACTCTACCTTGTGATC<br>TAGCCAGATCTTCTGGAGTATGTTGGACTGCAACTTGGCTAGTGGTCACAACA<br>CTCATCATTCACAGGATCCTGTTAACCTGACAAGAACTCTTCTCACCCAAGAA<br>GGCAACTTGGAAGCACAGAGTCTTGCCTTCATCCCTAGCAGTGTTCCTAGCCA<br>GCGAAGCAACTCTGGCTCTATTGGACAAAGGAAAATGTGTTACTGAACGTCTG<br>CGAGAGTTTGCATGCATGCTCTATGAAACAAGCACAGGACCTTGTACAGTGCT<br>CCACCACTGACCTGTGTGCCCAGTCCTTTACAAAGATTTCAAATCAACCTTTT<br>AAAAACTGTGCATAATATCTAATTTTATATACCCTAGTTGTTTCCCAACATAT<br>ATTAAAGATAAATGCATTCTTTTTACCAAAATGTGACTATATTATTTTCATGT<br>TTTCATATCTCTTTTTAAAATAAATTCTTTTAAAAAACT (SEQ ID NO: 169) |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | >NP_031675.1 0048 antigen isoform 1 precursor [*Mus musculus*]<br>MCFIKQGWCLVLELLLLPLGTGFQGHSIPDINATTGSNVTLKIHKDPLGPYKR<br>ITWLHTKNQKILEYNYNSTKTIFESEFKGRVYLEENNGALHISNVRKEDKGTY<br>YMRVLRETENELKITLEVFDPVPKPSIEINKTEASTDSCHLRLSCEVKDQHVD<br>YTWYESSGPFPKKSPGYVLDLIVTPQNKSTFYTCQVSNPVSSKNDTVYFTLPC<br>DLARSSGVCWTATWLVVTTLIIHRILLT (SEQ ID NO: 170) |
| Human CD226 | >NM_006566.4 *Homo sapiens* CD226 molecule (CD226), transcript variant 1, mRNA<br>GCAGATGGGAAGAAGCGTTAGAGCGAGCAGCACTCACATCTCAAGAACCAGCC<br>TTTCAAACAGTTTCCAGAGATGGATTATCCTACTTTACTTTTGGCTCTTCTTC<br>ATGTATACAGAGCTCTATGTGAAGAGGTGCTTTGGCATACATCAGTTCCCTTT<br>GCCGAGAACATGTCTCTAGAATGTGTGTATCCATCAATGGGCATCTTAACACA<br>GGTGGAGTGGTTCAAGATCGGGACCCAGCAGGATTCCATAGCCATTTTCAGCC<br>CTACTCATGGCATGGTCATAAGGAAGCCCTATGCTGAGAGGGTTTACTTTTTG<br>AATTCAACGATGGCTTCCAATAACATGACTCTTTTCTTTCGGAATGCCTCTGA<br>AGATGATGTTGGCTACTATTCCTGCTCTCTTTACACTTACCCACAGGGAACTT<br>GGCAGAAGGTGATACAGGTGGTTCAGTCAGATAGTTTTGAGGCAGCTGTGCCA<br>TCAAATAGCCACATTGTTTCGGAACCTGGAAAGAATGTCACACTCACTTGTCA<br>GCCTCAGATGACGTGGCCTGTGCAGGCAGTGAGGTGGGAAAAGATCCAGCCCC<br>GTCAGATCGACCTCTTAACTTACTGCAACTTGGTCCATGGCAGAAATTTCACC<br>TCCAAGTTCCCAAGACAAATAGTGAGCAACTGCAGCCACGGAAGGTGGAGCGT<br>CATCGTCATCCCCGATGTCACAGTCTCAGACTCGGGGCTTTACCGCTGCTACT<br>TGCAGGCCAGCGCAGGAGAAAACGAAACCTTCGTGATGAGATTGACTGTAGCC<br>GAGGGTAAAACCGATAACCAATATACCCTCTTTGTGGCTGGAGGGACAGTTTT<br>ATTGTTGTTGTTTGTTATCTCAATTACCACCATCATTGTCATTTTCCTTAACA<br>GAAGGAGAAGGAGAGAGAGAAGAGATCTATTTACAGAGTCCTGGGATACACAG<br>AAGGCACCCAATAACTATAGAAGTCCCATCTCTACCAGTCAACCTACCAATCA<br>ATCCATGGATGATACAAGAGAGGATATTTATGTCAACTATCCAACCTTCTCTC<br>GCAGACCAAAGACTAGAGTTTAAGCTTATTCTTGACATGAGTGCATTAGTAAT<br>GACTCTTATGTACTCATGCATGGATCTTTATGCAATTTTTTTCCACTACCCAA<br>GGTCTACCTTAGATACTAGTTGTCTGAATTGAGTTACTTTGATAGGAAAAATA<br>CTTCATTACCTAAAATCATTTTTCATAGAACTGTTTCAGAAAACCTGACTCTA<br>ACTGGTTTATATACAAAAGAAAACTTACTGTATCATATAACAGAATGATCCAG<br>GGGAGATTAAGCTTTGGGCAAGGGCTATTTACCAGGGCTTAAATGTTGTGTCT<br>AGAATTAAGTATGGGCATAAACTGGCTTCTGAATCCCTTTCCAGAGTGTTGGA<br>TCCATTTCCCTGGTCTTGGCCTCACTCTCATGCAGGCTTTCCTCTTGTGTTGG<br>CAAGATGGCTGCCAACTCTTGGCAATTCATACATCCTGTTTCTGTCTGGTAG<br>AGAGTTTGCTTCTCAAATGGAGCAAACAAATTTGATTATTTTTCATTGTTAA<br>ATAGGCAACATGACCAGAAAGGATGGAATGGCTTAAGTAAACTAAGGGTTCAC<br>TTCTAGAGCTGAGAAGCAGGGTCAAAGCACAATACTGGGCAATTCAGAGCATG<br>GTTAGAAGAGGAAAGGGGAGTCTCAAAGCTGGAGAGTTTACCAACAAATATTG<br>ACTGCAGTGATTAACCAAGACATTTTTGTTAACTAAAAAGTGAAATATGGGAT<br>GGATTCTAGAAATGGGGTATCTCTGTCCATACTTCTAGAATCCACTCTATCAG<br>CATAGTCCAGAAGAATACCTGGCAGTAGAAGAAATGAATATTCAAGAGGAAGA<br>TAAATGCGAGAGGGCAATCCTTTACTATTCTCATATTTATTTATCTCTCATTC<br>TGTATAGAATTCTTGCCGCCATCCCAGGTCTAGCCTTAGGAGCAAATGTAGTA<br>GATAGTCGAATAATAAATAACTTAATGTTTTGGACATATTTTGTCTACTTTTG<br>AGAATTATTTTTAATATGTAAATTCTCTCAAAAGGGTCAGGCACCTAGTTATT<br>ATTTTTTAATGATTATGTGAAAGTTGAATATAATATACCACTAAAAGTGACAG<br>TTGAAAGTGGTGGCATAGGACGGTAGGGTAGAAATTTGGGAGGGAAAAAAGAA<br>ATTGGGAGGGTACAGGCAACAGGAGAAAGGAATCAAACCACAGAAAAATACAA<br>AGGGAAACTTCTGCTTCACTATTCAGACAAAGACAGCCCTAATGACATCACCA<br>ACAGTCAAAGCAATTAGAGACCATACCTAATATTGTTTAAATTCTAGATGTAG<br>GCTAACAATGAAAAGTATTTGCCAAACTGAATAAAAACTGTCATGGTTACCTTG<br>AAAGGACAATGGTTATTGTTAAATATAGTGATCATTCATGTCTAAAAGATTCA<br>TTATTTATCTCTAAAGATTTCTAAAGACCACCATCTAGAAAAGATTCATTATG<br>AAGGCTGTATTTAAATATCAAAGTTGTGGACTTCATGATAATCTTAAATAAAG<br>CAAATCCAAATTCTCCTGTTGCCTAGACAGATTCTAAGATGTAATTTACACTT<br>TTAAGCTAATTAGTAGTATTTTATGATTTTAGCCTTAAACACCATGTATGCC<br>AAATAATGCACTTGTTTTGTGAATTACAGAAATGGTAAGTGCCCACATTTCTG<br>TGAATTATAAAATTTGTGAGTTTCTTTTAACCCTTTTCAGGAGTGAAAAAATA<br>AAAACGACCATTTCCTGGTTGTGCTTAAGTATATGCAAGAAGGGTAAACTCTC<br>ATTTTTATTATGTTTGCTTAAAGATCTTTTTATACCTGGATTCATGAAATGTT<br>TCCACAAATATATTAGTGTAACAAACTTGAAAGGCAGTTTACAAGAAAGCACT<br>CTACTATCAGATCAATCAAAGATTCTGTGAGTGAATTTATTGGTTTGCATGGT<br>GAAGCAAGCTTAGCATCAATTAAAAGGTAAATAATTTCTTTTCTGAATGGTAA<br>AGACAATCAAAATATTACTTTCTGGAAAACTCCAATAACCAAATTCTCAATGA<br>TTAGTGTATGTGAGCAGGAAAACATTTTTACAGTTGTAGTATGGGGAAATATA<br>AATCCAATTTTAAGAGAGAAAATTATGACTGGGTGTGGAAGGGACAGTATAGT<br>CAGATACCATTGTCATGGTGGTTTTTACTGGGAACTTCATGAAAGACTTTTGT<br>AGCAAACCACTGCAGTATTGCAAAGCCTCCAGAACATTTGGAACTTGTCTCTT<br>TTTCCTTGTGTGTGTTTGTGTTTTTGGTCTCTCATTCAAAATATTGATGAGAA |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | CTATTTACTCTGTCCTTTCTTCTCTATATATTCTTCCTCTACAGAGTGTAGGG
TTTTTTCAGGAATTTGGAGCCATCTGAAGTCCTCCCAAAAATTCTCTGACGTC
TTCTGATGCTCCTGTTATACCCTCAGGGGTAATGCTTGTGAAATTCCATTCAT
TCATTTTCTTTCTCTGGACATCTTTACTTACCAAAGCACTTTCATTGTCATCT
TTTTAACATCATTCTTAATTCGTGATAGTTTTGGGACTCTCCCTAGTGTATGT
TTCTCCCCCTCTACTCTTTTGCACCTATGATTCTGATTGTTACTAAGAAAGCA
GATGAAAAACAGATCCACAGAATAAACGATCAGAATTCCAGTAAATTCTATTT
TAAATACAGATACTTTTTACAAGTTGCTGCTTTGGAAGCAAAATGCTTCTTAA
GTTTTACATATATATATATATATACATATATATATACACATATAATTTATA
TCGATGGATAATACATTAAGAATCTATGCTTCCTTTGAATGCCATTAATATTT
ATGTTAAAGTAACCAATGAAAGGAAATTACTTTGTTATAATAAGATAGGAAGA
CTTGTTAATGGAGTACACAGTTTTGTCAGGGAAAGAACACATCTTATTGAACT
ATGATGACTATGCATTGACTATATTATTATAAGAGATACCTTCAAACTTTATT
TAAAGAACTTTAGGTATAATATGTTGAGAAAATAAAATAGAAATTTCATTTAC
TTGTAATCATGCTTAAAATGGGAGGCAGGTAGGTGAAGATATAATTTTAGTA
AAAACTCCAATTTATGTTTTAAGTAATTCAGTGTATTACTAAAATACTATATA
TATAAACTTAAAATACATGGGTTATCAATTTAAAAGACAAAGTAAGTAAAAAT
ACTTTTAGTAGGCATTCGTGGATTGTGAACATCCAAGTTATATTGGTTTGTAT
AGAATGGCATTAAGTAAAAATTACAGCTGTATAACAGTAGTTTTCTAAATTGA
GAGAGTCCACATTGTAATTAGAGATCACTGTGACCAAAATGCTTCTCCTTGAT
TTATAATGATGTACTGTATTTTGTACTGCTTATATGAAATTTCAGCAAGATTG
ACGATATTATAAAGATGCTTATAAAGTGTAAGTGGAGACGCTAAATTGTGAGT
ACAAAGTTTCTTTTTCACAACAGTGATAAGAAAATATCTTTAAAAAATATAAG
ACAATATAAACATGTCATCATTAGTTTTAGCTACTATTAAAATGTAACATCTAG
AAAGTACTGATCTCCACCTTCAGACTTCTGTATAAGTATATTTTTTCACTGAT
CTGTTCATTAGAGTTCTTCCAGCCAAGACTCTGGGCTCTTAAAACATGTATCT
GAAAACTAAAAACAAGTTAATTTTTTAAAAGCTTCTCTATTTCTAGTGATTC
AATAGGTAGAAAAATAGCTTCTAGAATTAACTGCAATGCTTTCTAAGGAAATT
TTATAAATCCTCAAGGTCGGTTTACACATATTTTTCCAGATTCAGAGCACTAA
CTATCTTGTAAGATGTAAGAAAAGGTCCATTTGGAAGTATGAGTAATAAATGT
CTGGGATAATTCTGGTTTATTTCGTATTATCCTTGTTAGAATAAGTTATATGG
TCAACCTGTTCAGAACACTTTTTCTAGTGTTAGTGTGTACTTTTGGATTTTTG
GTTCTTGTAGGGTATAGAAATATTTTCCTTTGTCTTGTATTCTGTTGTTTTGA
ATGAATAAAACACAATGTTTCACGATCACTACTTTCATTTGCCATGGAGAAAT
AGCAGGGAAAATTTCTACAGAATAAAATTAACTGATGAATTACATGCAGAAA
AAATTCAAATCAATGATACATTGTAATTTTATCTCAATGCAATGTTCTTTGT
ATTTTATTTTATTATTATTTTTTGAGACGGAGTTTCACTTTTGTTGCCCGGG
CTGGAGTGCAATGGCACAATCTCGGCTCACCACAACCTCTGCCTCCCGGATTC
AAGTGATTCTCCTGCCTCAGCCTCCTGAATAGCTGGGATTACAGGCATATGCC
AACATGCCTGGCTAATTTTGTATTTTTAGTGGAGACGGGGTTTCTCCACGTTG
GTCAGACTTGTCTTGAACTCTGGACCTCAGGTGATCCACCTGCCTCAGCCTCC
TAAATTGCTGGGATTACAGGCATGAGCGACCACTCCTGGCCTTGTTCTTTGTA
TTTTTATAAGTGCATGTAGTGCAAAGGGTCAAAGGGCTTTACAGGTTTTTGTT
TGTTTGTTTTTGTTTTTCCCGAAACATAGTAGTCCCTTGCCCTTCCTCATTTT
TGTTACCTTGAGACAACAAATTTTACTACTTCTAACTCATTATTTTATTTATG
TTCACTTTTCTGAATAGCATGCTTATGACACTAATACTTTTTTTTTCAATTTT
AGACATTCATTATTCATTTAGATGTCTTTCTCTCCCCAAACTCACCACATAAA
ATACTCTTCTCATGTCTCTTTCAGAAATATTTGTATTAAAATATGATTATATC
AATATTTGGCATTTATTTCTTATGACCTTGCCAGTACTCTTAGTTAAACTACA
TGGTAAAAATGATTTTGCTTTCCCTCCTACATAACTTTTTTTCCACCTAGAGC
TAATAATTGTCATTCTGGGGACTGACTTTTTCTGTATTTACCATAAATTGACC
TGAAACTCCCCTGTGATGCAGCAGGAATTCTACCAACGTCAACTTCCTTAGAA
AGACTCCATTAGAAGCTTGACTTGGGGCTAGAAGGAGAGGCACACAACTGCCA
TCCTGGTGTCTCCCTTCATCCAGAAAAGGGGGAGGAATACATGAAACCTAGA
ATCCACTCTAAAACATTTTCCAGAACAAAAGGACATGTGTTTCCGTGTTGTAA
ATGTTTAACGAGTGCCCATAACAAGGAATAATAAGTCTATTATGTTTGCTTTT
GTGTCTGTAAAAGTTGGGGGTATTGGTTGTAAGCACGAAAACAGATACTGACT
GTTGAAGAAAAAAAAAAATACGAGGTCAGGAGTTTGAGACCAACTTGGCCAAT
ATGGTGAAACCCTGTCTTAGTAAAAATAGAAAAATTAGCCAGGCCTGGTGGCA
CGCACCTGTAGTCCCAGCTACTTGGGAGGCTGAGGCAGAAGAATCGCTTGAAC
CCGGGAGGCAGAGGTTGCAGTGAGCCAAGATCGCACCACTGCACTCCACCCTG
GGCAACAGAGCGAGACTCCGTCTCAAAAAAAAAAAAAAAAAAAAAAAAAAAAA
GTTAAGTATTTGAACATAGGGGTGGCTCATAGAATTCCCAGGACACCCGATGG
AGTAGGCTTGCAAAACACAACATGTGGCAACTCCAGTGGGAAACGAGGCAGGA
AACACTCGTTTCCTGCAGAAAGCAACAATTTGGGCTTCGATACCCTCCCTAGA
ACACAGGGCAGTGAATCTGAGCAGCATCAGTACCCCACGTTCGGATGAGTCCT
GAGCCCCTATTTTTATTCACTGACTTATTCCAAAATCAGTGTCTCTTAAATAT
ATCTGGAAGGCAGCAGCTTGTATCTCCCCCTTCAGCTTCCATAGTGGCAGTCA
GGGTACAACTTACTTTCCAAACAGAACACACTGCGACATTCCCTCCAGGCTCG
TTGAAGAACTTCAACTGACAAATGTCCCTCCTCGACCAGATGATAGTTTTCTT
AAAGGCAGGGTTTAATATACCCTTTTATAAATGTTTCAAGGCCCTGTGTAATA
CCTGAGTTTATTCCAGATGTAACTAAATATATCCAAGATTGTTTTAAAATAAA
TTGCTGAAAAACAAATAAATACAGTTAGTATCTATATCAATATTCTCAGTTG
GCAGTTTTGCAATAATGGCCGATAGTTCATTTTTAGTAACACTATTGACATTG
CATTTGGATATTAGGGTTTACTAATCATCCGCATGTATACATTGCATATTTTT |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | CTAGACTTTAACTTTATTCAAATCTATTGATTTTTAAACCTGCAACTTATGTC<br>TAGACACAGGTATACCTTTACAAGAACTACCATTTTTTTGGTAACATACTAC<br>CTCCAAAATTTCAAGTAAGAAGTTGATTTTTGTCCATTTTTAAATGGAAAACT<br>TGTAATCAAAATGCCACAAAATTATACTGTGTATCATTTGACCTATAGAAACC<br>AATATTATTACAGGAAGAAAGCAGAGCCAATCTTCTACCTGTGGTCAAATAAG<br>TGGAGGCCCTTCTAGACTAAGTTCTCATGAGTTTAAAATACCAAGCATAAGT<br>TCTCCAAATTCCTGAAAAGGAAGCCTTGTGTTGTATTGCCCAGCCATATTTGT<br>AAGACATAAAAATAAAACTTGAGAAGAAGCTATGATAACTTACTTTCTTCATT<br>CTTCAAAATTTACATAATCTCAACTGATTTTATGTTTTTATGAAAATGCATTC<br>TTAAGATATATCCTTATTCAATCATGTATTCATTACATCCTTTATGCCAGGTA<br>TCCAAAAGTACTTACAGTGACTAAGACCATTATTCTTTGATCAGCTGCCTGAG<br>TAAGACTTTGAGCTCTCCAATATACTCTCAGTGATACTAAGGTTTTCTGAGTAA<br>CAGCTTTGGATGTGGCTTCAGTTGAGCTGATTTATCCCACACTTTATTTTTAT<br>CGTATAATGGTCCTCAGAAGCAAATTTTGATTTTAGCTCACATAAAAAATGTA<br>CAAAGAAATGTAATGGCTCAGTAGCTTCTAGAGATAGAGATTACTCTTCTAAC<br>CTTTCTGTAATTTTGTATGTCTATTTTATAATTCTTTCAATGTCTAATGAATA<br>GCTATCTTTTTTTGAGACGGAGTCTCGCTCTGTCGCCCAGGCTGGAGTGCAGT<br>GGTGCGACCTCGGCTCACCGCAAGCTGCGTCTTCCAGGTTCACGCCATTCTCC<br>TGCCTCAGCCTCCCGAGTAGCTGGGACTTCAGGCGCCCACCACCATGCCCAGC<br>TAATTTTTTTGTATTTTTAGTAGAGACGGGGTTTCACCGTGTTAGCCAGGGTG<br>GTCTCGATCTCCTGACCTCGTGATCCGCCCGCCTCGGCCTCCCAACGTGCTGG<br>GATTACAGGAGTGAGCCACCGCGCCCGGCCTCCTTAGTTTCTTAAGGTGGAAG<br>CCTAGATTATTGATTTTATATGTTGTTTTCTTTTCCAATAGTGGCACTTAATG<br>CTATAAATTTCACTTTGTTCCACAAGTTTTGGTAAGCTCTATTTTTATTTTCA<br>TTTAGTCCAAAATATTTTAAAATTTCTTTTGATATTTCTTCTTTGAGCCATGA<br>ATTATTTACAATGTGTTGTTTAATCTCTATATATTTGGGATTTTTCTACTTT<br>ATATCTCTTACAGATTTCTAACTTAATTTCATCATGTTTTAAAAACATTCTTT<br>GTATAATTTCTATTCTTTTAAATTTTTCAGGTGTATTTTATGGCCCAGAATAT<br>GGTCTATCTTGTAGAATGTTTCATGTGATCTTAAGAAGAATGTTCATTCTGCT<br>GTTGAGTGTAATATTCTACAAATGTCCATTAGATTAAACTGATTGATACCACC<br>GTTCAGATTATCTATATCCTTTCTGATTTTCCCTCTTCTTGATCTATCACATA<br>CTGACAGATCAAGTGATCAAGTCTCGTTAAAGACTGCAAGTAAAATAGTGGAT<br>TTTTCTATTTCTCCTTGCAGTTTTGTTAGTTTTTGTCTCATGTATCTTGATAC<br>TCTTGTTAGTACATATACTTTCAGAATCGTTAGGTTTTCTTGGAGAATTGACC<br>CCTTTACCACATGTAATGTCCCTTTTATTCTTGATAATCTTTCTTGTTCTGTC<br>TGCTTTTTCTGATATTAACATAACTTTCAGTTTTTTAAAAAATTAACATTAGC<br>ATCTCACATCTTTATCCTTTTAATTTTAAATTATCTAAATATTTATATTTAAT<br>GTGCCTTTCTTATAGACAATGTATAGTTGCGTCTATTTGTAATTTCCCCACTT<br>TTCTTACTTAAAAATGTTGTAGATATATAGGAGTTGTATATATTTGGGGGGTA<br>CATGTGATGTTTTGATACCTGTATACAATATGTAATGATCATATTGGGTAATC<br>GTGATATCTGTCACCTCTAACATTCATCTTTTTTGTGTGTTTAAACCCACCAC<br>TTCTAATTGGTACATTTAGATTATTCAAATTTAAGTGATTATTGATATAGTTG<br>GATTAATATCTACTATGTTTGTAACTTTTCTATCCTTGCACTCGTTCTTTCTT<br>TTTTATCCTCCTTTTTCTGTGTTCTCTGATTTTAACTGGGGTTTTTACATGAT<br>TTAATTTTCTCTCGTGGCATATCTTTCATTGATCAACCTAGGTTTTTCTCCTT<br>TTCCCCTCTTTTTTTTGGTATTTATTCTATTTAGTGTTATCTGAGCTACCTGA<br>GTTGGTGTCTATCACTAATTTTGGCAAGTTCCCAGACGTTATTACTTCTAACA<br>TTCTTTTGCTCCATTCTTTCTTCTTCTTCAATTATTCCATAGTCTTGAATATT<br>CTGGGTTTTTCCCACTCTTTGAATTTTAGTTTTGAAAAGTTTCTATTGGCCTAG<br>CTTCAAAGTCATTCATTCTTCCTTCGGGGTTCCAAGTCAACTGATAATTGCAT<br>CAAAGATATCCTTCCTTTCTATTACTATGTTTTTTATTGCTACCATTTCTTTT<br>TTATTCCTTCTTAGTGTTTCCATCTTTCTTCTTACATTATCCATCTGTTGTCT<br>ATTTTTTTCATGAGAGCTCTTAACATATTAATGATAAGTTCCATGTCTGATAA<br>TTCTGACACGTGTCATGTCTCTATCTGGTTCCAATGATTGCTTTATCTCTTCA<br>GACCATGACTTTTCTTGCCTTTTGACGTTCTTTGACATTTTTTTTGAATTTTT<br>TGTTGCAAGCCAGATCTGGTGTGTTATGTAATAGGAACAGGTAAATAAGTCTT<br>TAGCTTGCAGACTTATCTTAATCTGACTAACTATTAGACTGTGTTAAAGTCT<br>GTTATAACCATAGGTGCTAAATTTCTTCAAATTCCTCTAGTGTCTTTGTTTTG<br>TTTGTTCATGTGTTTTTCCCCTTCTTGAGTTCAGGCTTCCCTAAGTGCTCCTC<br>TTCAGAGAGACTTTCTGTCTTTCAGCTCTTTCCTCTGCAATTCACTGTTACTA<br>TACTGGAGCCCTGTTGGTGTAGTACTAAGCTGTGGGAAAGGAGAGTGCTCTGT<br>AATCTTACAGTGAAATCTCAGTGTTTTAGTGGGTCTGTGTCTGGGACATTCAC<br>AGAGCTTCTCCAGTGGTATTGCTTCCTCATCCTCAACTCTCTTTCCTGGCTGC<br>AGCATTCCCAATGTATTTCTTTGAAGGCCTGCCCCCTGTTGACTGTTATTTTC<br>CCTCTTTCCTTAAGTGGGACAGGGAGACTTCAGGGGCTGGGATGAGGTTTGGG<br>AATTGTGCTTGGCAGAGTCCTTTCCATCTTTGTTACCAAGAAGGTTCATGGCT<br>TATTTCTCAATGGATGTCCCTCTCTATCTGTTGCCAGAGCCACGAGGAAATTT<br>TTCTTGGATCCTCATAATGAGAACCTTGGAGTTTCCTACTGGAAAAGCCCTTG<br>AATGTGTGGAGTGCCTCAAGAGCACAGCCCCCATGGGTTTCTTGCTCACACCA<br>GTCCACAAACAGATGCCAGCAATTCACCCAACTTACCATATAAAGGCTCATAC<br>TAGTTTATGGCTCCAGTGCTTTGACTCCAGATAAATGGCTATTGGTTGCGTAT<br>CTCTCTGGATGTATCTGTATCTCCAGATTTTGGGGTGGCAGTTTGCTCAGGAC<br>CTTGGTTCTCTAATAGGTCTAATAAGAAAAGTCATTGATTTTCAGCTTTCCAA<br>CTTTCCAGCTTTGTCTTGTTATAAGCATGGCAGCAACATCTTCCATGCCTTAA<br>CATGATGACACTAAAGGCAGAAGTCGATCTCCATGTATAAACATTTTAACACA |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | TATGTTTTTTGTTATCGTGGTTTCTGACCTGTCTCTTTGCCCTGACTTTCTGA<br>TACTGCACTAGGGTTCCTGTTGCTGGACTCCATTCCATATGACTTGCTCTCGT<br>CTAGGCTGCTCTTTGGCTCATCTTTATAAATCATGATCCAAAATGAAGCACAT<br>ATTTATTTTTTAAATAAATATGAAATGAAGTATAGACATCAAACTGAAGATGA<br>GTAGATCATACTGAGTTTCACTGTCTGTGCTTGGATCAACATCAGGCCTTATA<br>CAAATATTCAAGTCCAGAGGCAAAAGGTAATAAGGAAAATTTGTAGCACAAGC<br>CACAAGGAGATAACATGTCAAGTCTATGCGATTGGAAATAAACTAAAGATGAA<br>CTGCTGGGGATGCTCACTCATCACAGAGCTCAGTCTAAAGCACCAGATTTCAC<br>AAGCATTTTTTGGGGGAAATTCTGTTAAAATGAAATATGAGTTCACATGGTGGT<br>GTTTCACTCATCATATGTGTTCAATATTAATTCATTTTAAGGTTTAGTTGCAC<br>AAAAGGTAAATGAGAATTAGAAGACTCCATGGGTAAGAGGAGCCACAGAAGTA<br>AAGCATTGTCAAGGGTTCTATGTCTATATATTTAGATATTAGGCTTCTGAGAA<br>AAAAACACAATAGGAAGGAAGATGAACACAACAGAGGGCAGAAGGTCTATACG<br>TCCTGAGGCCTTTTATGCAACGTTTGTTTGTGGAATGTTTTTTAAGAATGTGT<br>GAGAGTCATTTTAATGTGAAATAAAGACCTACGTCTACA (SEQ ID NO: 171)<br><br>>NP_006557.2 CO226 antigen isoform a precursor [Homo sapiens]<br>MDYPTLLLALLHVYRALCEEVLWHTSVPFAENMSLECVYPSMGILTQVEWFKI<br>GTQQDSIAIFSPTHGMVIRKPYAERVYFLNSTMASNNMTLFFRNASEDDVGYY<br>SCSLYTYPQGTWQKVIQVVQSDSFEAAVPSNSHIVSEPGKNVTLTCQPQMTWP<br>VQAVRWEKIQPRQIDLLTYCNLVHGRNFTSKFPRQIVSNCSHGRWSVIVIPDV<br>TVSDSGLYRCYLQASAGENETFVMRLTVAEGKTDNQYTLFVAGGTVLLLLFVI<br>SITTIIVIFLNRRRRRERRDLFTESWDTQKAPNNYRSPISTSQPTNQSMDDTR<br>EDIYVNYPTFSRRPKTRV (SEQ ID NO: 172) |
| Mouse CD226 | >NM_178687.2 Mus musculus CD226 antigen (Cd226), transcript variant 1, mRNA<br>ACACAGAAGACTTCTTGACTTCAGGAGACACTGCTGTATGAAACAGTGCTTGC<br>TATCAGTGGCTGCTGGAAGAGGCTGTGGTGGAAAGAAAACCTCAACTGCAGGC<br>CAGAGTTGGTTCCCCAAAAGAGGCAAACTCCCAGTGCTAGCCAGAGGCTAGGA<br>AGCTCTAAGCAACCCACTTATCTGCAAGGAGAGTTACGCCCAAAGAGCATCAA<br>GTCCAACCTCCTGAACTGTTTCCAGAGATGGCTTATGTTACTTGGCTTTTGGC<br>TATTCTTCATGTGCACAAAGCACTGTGTGAAGAGACATTGTGGGACACAACAG<br>TTCGGCTTTCTGAGACTATGACTCTGGAATGTGTATATCCATTGACGCATAAC<br>TTAACCCAGGTGGAGTGGACCAAGAACACTGGCACAAAGACAGTGAGCATAGC<br>AGTTTACAACCCTAACCATAATATGCATATAGAATCTAACTACCTCCATAGAG<br>TACACTTCCTAAACTCAACAGTGGGGTTCCGCAACATGAGCCTTTCCTTTTAC<br>AATGCCTCAGAAGCAGACATTGGCATCTACTCCTGCTTGTTTCATGCTTTCCC<br>AAATGGACCTTGGGAAAAGAAGATAAAAGTAGTCTGGTCAGATAGTTTTGAGA<br>TAGCAGCACCCTCGGATAGCTACCTGTCTGCAGAACCTGGACAAGATGTCACA<br>CTCACTTGCCAGCTTCCAAGGACTTGGCCAGTGCAACAAGTCATATGGGAAAA<br>AGTCCAGCCCCATCAGGTAGACATCTTAGCTTCCTGTAACCTATCTCAAGAGA<br>CAAGATACACTTCAAAGTACCTAAGACAAACAAGGAGCAACTGTAGCCAGGGG<br>AGCATGAAGAGCATCCTCATCATTCCAAATGCCATGGCCGCTGACTCAGGACT<br>TTACAGATGTCGCTCAGAGGCCATTACAGGAAAAAACAAGTCCTTTGTCATAA<br>GGCTGATCATAACTGATGGTGGAACCAATAAACATTTTATCCTTCCCATCGTT<br>GGAGGGTTAGTTTCACTGTTACTTGTCATCCTAATTATCATCATTTTCATTTT<br>ATATAACAGGAAGAGACGGAGACAGGTGAGAATTCCACTTAAAGAGCCCAGGG<br>ATAAACAGAGTAAGGTAGCCACCAACTGCAGAAGTCCTACTTCTCCCATCCAG<br>TCTACAGATGATGAAAAAGAGGACATTTATGTAAACTATCCAACTTTCTCTCG<br>AAGACCAAAACCAAGACTCTAAGCTGCTCTTTTGGCCTGAACACATTAGTGAT<br>GACTTCTATGGCATGGAATTTTACCCATGATTTCCTTACCACTAGGATCTACA<br>TTGATAAAAAAAATTGATTAAATTTATTTCATCTCATATATAGAAGTACTTTA<br>TTACCTGGAAACATTCTTAATAGAGATTCATTAGAAAACCCAAATCTAATGTT<br>CATGTGTTCAAGGAACCTTCTTCCATTATGTAACAGAACAGTCTAGAGAAGAT<br>TAAGGACCACATGGCTTTCTTGCTCTACTTGAAATTAATTGTGAGCATAAGCT<br>TGTTTCTGGAGTCTTCTTACATTGTTGGTTCTACTTACATACTACTGGTCCAA<br>CTCTCATGCTGTTTCTCTCAGATGTTCCCATGATGGTTGCCAAGGACACTTGA<br>TAGAAAGACTACTGGTTAAACACAATAAACAAAGTTCATTATTCACTTATTAG<br>CAAGAAGGTAGCATTATCATAAAGGATTAGATGACTTAAGTTAGCTATAGGTT<br>CAAGACCTGGACTAAAGTATTACTTGGAAATTCTGAGTATTGCTAAAAAGGAG<br>GATGAAAGGGACCTAGAAGTTGAGTTATTACTAAAAACTTTGAGTGCGAAGAT<br>ATTACTCATTAACCAGATAACAAGTGAATATGCTGTAGCATCAACATAATTCA<br>AAAGAGTAAAGAAATGGCTAGGAATGAGGTAGTTGTGTAATTATTCTTCTCT<br>TACTAGTTTCAAATAAATTCATCTCTAATTCTATAGAGAATTCTTGCCTCCCA<br>TTCAGGACTGGCCTTCTATACAGTGAGATGGTCCAGTAAGAAATAATTTTTAT<br>TAGTGTTTTTTCTATTTTGAGAATTATTTTAATATATATTTAATATATAAAC<br>TTGTGAGTTAAATTTTTTTTTTGCAAAATTAGCACATGAAAAGAGATTGATGG<br>TTTTAAGTAGTAGAACACAGTAGTGTAGGAATCTGAGAGCAGAGAGTTTGGGA<br>GGGGGTGAAGAGAAAACAACATCACCAAATAGTGATATATAAGAGAAAATCTG<br>TGCTTCAGAGTTTGATCAGGGCCATCTCTCCCAACTCTGCTGGAACTGAGAGA |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | ATGCACCTGATGTTGTCTCCATTTTAGATAGAGAAAAAAAAAACCCGAATATT<br>TATAAAACTAAATAAAACTATAGTTACCTCAAAACTATGGGGATCACTATAAC<br>ATAGAATAGAATAGAATAGAATAGAATAGAATAGAATAGAATAGAATAG<br>(SEQ ID NO: 173)<br><br>>NP_848802.2 CD226 antigen isoform a precursor [Mus musculus]<br>MAYVTWLLAILHVHKALCEETLWDTTVRLSETMTLECVYPLTHNLTQVEWTKN<br>TGTKTVSIAVYNPNHNMHIESNYLHRVHFLNSTVGFRNMSLSFYNASEADIGI<br>YSCLFHAFPNGPWEKKIKVVWSDSFEIAAPSDSYLSAEPGQDVTLTCQLPRTW<br>PVQQVIWEKVQPHQVDILASCNLSQETRYTSKYLRQTRSNCSQGSMKSILIIP<br>NAMAADSGLYRCRSEAITGKNKSFVIRLIITDGGTNKHFILPIVGGLVSLLLV<br>ILIIIIFILYNRKRRRQVRIPLKEPRDKQSKVATNCRSPTSPIQSTDDEKEDI<br>YVNYPTFSRRPKPRL (SEQ ID NO: 174) |
| Human DR3 | >NM_003790.3 Homo sapiens TNF receptor superfamily member 25 (TNFRSF25), transcript variant 2, mRNA<br>GAAGGCGGAACCACGACGGGCAGAGAGCACGGAGCCGGGAAGCCCCTGGGCGC<br>CCGTCGGAGGGCTATGGAGCAGCGGCCGCGGGGCTGCGCGGCGGTGGCGGCGG<br>CGCTCCTCCTGGTGCTGCTGGGGGCCCGGGCCCAGGGCGGCACTCGTAGCCCC<br>AGGTGTGACTGTGCCGGTGACTTCCACAAGAAGATTGGTCTGTTTTGTTGCAG<br>AGGCTGCCCAGCGGGGCACTACCTGAAGGCCCCTTGCACGGAGCCCTGCGGCA<br>ACTCCACCTGCCTTGTGTGTCCCCAAGACACCTTCTTGGCCTGGGAGAACCAC<br>CATAATTCTGAATGTGCCCGCTGCCAGGCCTGTGATGAGCAGGCCTCCCAGGT<br>GGCGCTGGAGAACTGTTCAGCAGTGGCCGACACCCGCTGTGGCTGTAAGCCAG<br>GCTGGTTTGTGGAGTGCCAGGTCAGCCAATGTGTCAGCAGTTCACCCTTCTAC<br>TGCCAACCATGCCTAGACTGCGGGCCCTGCACCGCCACACACGGCTACTCTG<br>TTCCCGCAGAGATACTGACTGTGGGACCTGCCTGCCTGGCTTCTATGAACATG<br>GCGATGGCTGCGTGTCCTGCCCCACGAGCACCCTGGGGAGCTGTCCAGAGCGC<br>TGTGCCGCTGTCTGTGGCTGGAGGCAGATGTTCTGGGTCCAGGTGCTCCTGGC<br>TGGCCTTGTGGTCCCCCTCCTGCTTGGGGCCACCCTGACCTACACATACCGCC<br>ACTGCTGGCCTCACAAGCCCCTGGTTACTGCAGATGAAGCTGGGATGGAGGCT<br>CTGACCCCACCACCGGCCACCCATCTGTCACCCTTGGACAGCGCCCACACCCT<br>TCTAGCACCTCCTGACAGCAGTGAGAAGATCTGCACCGTCCAGTTGGTGGGTA<br>ACAGCTGGACCCCTGGCTACCCCGAGACCCAGGAGGCGCTCTGCCCGCAGGTG<br>ACATGGTCCTGGGACCAGTTGCCCAGCAGAGCTCTTGGCCCCGCTGCTGCGCC<br>CACACTCTCGCCAGAGTCCCAGCCGGCTCGCCAGCCATGATGCTGCAGCCGG<br>GCCCGCAGCTCTACGACGTGATGGACGCGGTCCCAGCGCGGCGCTGGAAGGAG<br>TTCGTGCGCACGCTGGGGCTGCGCGAGGCAGATCGAAGCCGTGGAGGTGGA<br>GATCGGCCGCTTCCGAGACCAGCAGTACGAGATGCTCAAGCGCTGGCGCCAGC<br>AGCAGCCCGCGGGCCTCGGAGCCGTTTACGCGGCCCTGGAGCGCATGGGGCTG<br>GACGGCTGCGTGGAAGACTTGCGCAGCCGCCTGCAGCGCGGCCCCGTGACACGG<br>CGCCCACTTGCCACCTAGGCGCTCTGGTGGCCCTTGCAGAAGCCCTAAGTACG<br>GTTACTTATGCGTGTAGACATTTTATGTCACTTATTAAGCCGCTGGCACGGCC<br>CTGCGTAGCAGCACCAGCCGGCCCCACCCCTGCTCGCCCCTATCGCTCCAGCC<br>AAGGCGAAGAAGCACGAACGAATGTCGAGAGGGGGTGAAGACATTTCTCAACT<br>TCTCGGCCGGAGTTTGGCTGAGATCGCGGTATTAAATCTGTGAAAGAAAACAA<br>AACAAAACAAAAACGGCTTCTTGGCGTTTCTGCGGGGCTGGGGTGTTAAGTGG<br>ACTGGACTTTTCTCGAGGGATTCGAAGGGACGGGAATCTTGTCACCCCGGGA<br>TCTGGCACCCATGGTGGAGTCCAGTGTGGCCTTAGCTCCCAAGCCTGCCCCTC<br>CCGAGTCCACTCTGGCTCAATTACCCCGAGAAGGAGAGAGCAAGTCGCGGCCA<br>CAGCGAGTGAGTGAACCGGAGCCCAGATGAGAGCGCTTTAATGGGGCTGCGAG<br>GTGGCGGAGACAGGGTCGGGATGGGGTGCAGCAGTTGGAGACACAGGGTCAGG<br>GCCCCTCATCCTCTATTCACTCCACCGGGGCAGTGAAAGGGTCCCGGCAGCGA<br>GTGGGTC (SEQ ID NO: 175)<br><br>>NP_003781.1 tumor necrosis factor receptor superfamily member 25 isoform 2 precursor [Homo sapiens]<br>MEQRPRGCAAVAAALLLVLLGARAQGGTRSPRCDCAGDFHKKIGLFCCRGCPA<br>GHYLKAPCTEPCGNSTCLVCPQDTFLAWENHHNSECARCQACDEQASQVALEN<br>CSAVADTRCGCKPGWFVECQVSQCVSSSPFYCQPCLDCGALHRHTRLLCSRRD<br>TDCGTCLPGFYEHGDGCVSCPTSTLGSCPERCAAVCGWRQMFWVQVLLAGLVV<br>PLLLGATLTYTYRHCWPHKPLVTADEAGMEALTPPPATHLSPLDSAHTLLAPP<br>DSSEKICTVQLVGNSWTPGYPETQEALCPQVTWSWDQLPSRALGPAAAPTLSP<br>ESPAGSPAMMLQPGPQLYDVMDAVPARRWKEFVRTLGLREAEIEAVEVEIGRF<br>RDQQYEMLKRWRQQQPAGLGAVYAALERMGLDGCVEDLRSRLQRGP (SEQ ID NO: 176) |
| Mouse DR3 | >NM_033042.4 Mus musculus tumor necrosis factor receptor superfamily, member 25 (Tnfrsf25), transcript variant 2, mRNA<br>CTGCGTGGAGGGGAAATGGGCCAGAGGCTGCTGGCAGGGGGCCTCCTCTGCTG<br>TACACAAGCTGGTTTTGTAGACAGTGAGAGGGAAGCTGATCCCAGTCCCCTAA<br>CCCTGTTCTGCCCAGGAGCCTGAGAACTGAGCTTACTCGGGCAAATGCTAGGG |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | CTTCAGAAATGGAGGAGCTGCCTAGGAGGGAGAGGTCACCTCCTGGGGCAGCC<br>ACACCAGGGTCAACTGCACGTGTTCTCCAGCCTCTGTTCCTACCACTGCTGCT<br>GCTGCTGCTGCTGCTCGTTGGTGGCCAGGGCCAGGGCGGCATGTCTGGCAGGT<br>GTGACTGTGCCAGTGAGTCCCAGAAGAGGTATGGCCCGTTTTGTTGCAGGGGC<br>TGCCCAAAGGGACACTACATGAAGGCCCCCTGCGCAGAACCCTGTGGCAACTC<br>CACCTGCCTTCCCTGTCCCTCGGACACCTTCTTGACCAGAGACAACCACTTTA<br>AGACTGACTGTACCCGCTGCCAAGTCTGTGATGAAGAGGCCCTTCAAGTGACC<br>CTTGAGAACTGCTCGGCAAAGTCGGACACCCACTGTGGCTGCCAGTCAGGCTG<br>GTGTGTTGACTGCTCCACCGAGCCATGTGGGAAAAGCTCACCTTTCTCTTGTG<br>TCCCATGCGGGGCTACAACACCAGTCCATGAGGCTCCAACCCCCTGTTTTGG<br>GTCCAGGTGCTTCTAGGAGTCGCGTTCCTTTTTGGGGCTATCCTGATCTGTGC<br>ATATTGTCGATGGCAGCCTTGTAAGGCCGTGGTCACTGCAGACACAGCTGGGA<br>CGGAGACCCTGGCCTCACCACAGACTGCCCATCTCTCAGCCTCAGACAGCGCC<br>CACACCCTCCTGGCACCTCCAAGCAGTACTGGGAAAATCTGTACCACTGTCCA<br>GTTGGTAGGCAACAACTGGACCCCTGGCTTATCCCAGACTCAGGAGGTGGTCT<br>GCGGACAGGCCTCACAACCCTGGGATCAGCTGCCAAACAGAACTCTTGGAACT<br>CCTCTGGCATCTCCGCTCTCGCCAGCGCCCCCTGCGGGCTCTCCGGCTGCTGT<br>GCTCCAGCCTGGCCCGCAGCTACGATGTGATGGATGCGGTCCCAGCACGAA<br>GGTGGAAGGAGTTCGTGCGCACGCTGGGGCTGCGGGAAGCGGAAATTGAAGCC<br>GTGGAGGTGGAAATCTGCCGCTTCCGAGACCAGCAGTATGAGATGCTCAAGCG<br>CTGGCGTCAGCAGCAGCCTGCAGGCCTCGGTGCCATCTATGCGGCTCTGGAGC<br>GCATGGGTCTGGAAGGCTGTGCCGAGGACCTGCGCAGCCGCCTGCAGCGTGGC<br>CCGTGATGGAAGGTCCATCAGCCACTTTGACACCCTAGTGACCCTTGAAGGAG<br>CCTTAAGTATTGTTACTTATGCGTGTAGACATTTTATGTCAATTACTAACCCC<br>CTGCCGTGGTCCTGCGTAGCAGGGCTGGCTGCCTCACTTTTGCTTATCTGCAG<br>CACGGAGCTCCTGCTAAGGGAAGCGTCATGGAGAAATACCAGAAGGGGCCAAG<br>TGATTGGTTGCTCAGCTGTTAATTAGCCCGAGTTTGGACTTGGTATTAAATTT<br>CGTAAGAAAAGCAGCTGCTTG (SEQ ID NO: 177)<br><br>>NP_149031.2 tumor necrosis factor receptor<br>superfamily member 25 isoform 2 precursor [Mus<br>musculus]<br>MEELPRRERSPPGAATPGSTARVLQPLFLPLLLLLLLLGGQGQGGMSGRCDC<br>ASESQKRYGPFCCRGCPKGHYMKAPCAEPCGNSTCLPCPSDTFLTRDNHFKTD<br>CTRCQVCDEEALQVTLENCSAKSDTHCGCQSGWCVDCSTEPCGKSSPFSCVPC<br>GATTPVHEAPTPLFWVQVLLGVAFLFGAILICAYCRWQPCKAVVTADTAGTET<br>LASPQTAHLSASDSAHTLLAPPSSTGKICTTVQLVGNNWTPGLSQTQEVVCGQ<br>ASQPWDQLPNRTLGTPLASPLSPAPPAGSPAAVLQPGPQLYDVMDAVPARRWK<br>EFVRTLGLREAEIEAVEVEICRFRDQQYEMLKRWRQQQPAGLGAIYAALERMG<br>LEGCAEDLRSRLQRGP (SEQ ID NO: 178) |
| Human DcR3 | >NM_003823.4 Homo sapiens TNF receptor superfamily<br>member 6b (TNFRSF6B), mRNA<br>GGACTTGGGCGGCCCCTCCGCAGGCGGACCGGGGCAAAGGAGGTGGCATGTC<br>GGTCAGGCACAGCAGGGTCCTGTGTCCGCGCTGAGCCGCGCTCTCCCTGCTCC<br>AGCAAGGACCATGAGGGCGCTGGAGGGGCCAGGCCTGTCGCTGCTGTGCCTGG<br>TGTTGGCGCTGCCTGCCCTGCTGCCGGTGCCGGCTGTACGCGGAGTGGCAGAA<br>ACACCCACCTACCCCTGGCGGGACGCAGAGACAGGGGAGCGGCTGGTGTGCGC<br>CCAGTGCCCCCCAGGCACCTTTGTGCAGCGGCCGTGCCGCCGAGACAGCCCCA<br>CGACGTGTGGCCCGTGTCCACCGCGCCACTACACGCAGTTCTGGAACTACCTA<br>GAGCGCTGCCGCTACTGCAACGTCCTCTGCGGGGAGCGTGAGGAGGAGGCACG<br>GGCTTGCCACGCCACCCACAACCGTGCCTGCCGCTGCCGCACCGGCTTCTTCG<br>CGCACGCTGGTTTCTGCTTGGAGCACGCCATCGTGTCCACCTGGTGCCGGCGTG<br>ATTGCCCCGGGCACCCCCAGCCAGAACACGCAGTGCCAGCCGTGCCCCCCAGG<br>CACCTTCTCAGCCAGCAGCTCCAGCTCAGAGCAGTGCCAGCCCCACCGCAACT<br>GCACGGCCCTGGGCCTGGCCCTCAATGTGCCAGGCTCTTCCTCCCATGACACC<br>CTGTGCACCAGCTGCACTGGCTTCCCCCTCAGCACCAGGGTACCAGGAGCTGA<br>GGAGTGTGAGCGTGCCGTCATCGACTTTGTGGCTTTCCAGGACATCTCCATCA<br>AGAGGCTGCAGCGGCTGCTGCAGGCCCTCGAGGCCCCGGAGGGCTGGGGTCCG<br>ACACCAAGGGCGGGCCGCGCGGCCTTGCAGCTGAAGCTGCGTCGGCGGCTCAC<br>GGAGCTCCTGGGGGCGCAGGACGGGGCGCTGCTGGTGCGGCTGCTGCAGGCGC<br>TGCGCGTGGCCAGGATGCCCGGGCTGGAGCGGAGCGTCCGTGAGCGCTTCCTC<br>CCTGTGCACTGATCCTGGCCCCCTCTTATTTATTCTACATCCTTGGCACCCCA<br>CTTGCACTGAAAGAGGCTTTTTTTAAATAGAAGAAATGAGGTTTCTTAAAGC<br>TTATTTTTATAAAGCTTTTTCATAAAA (SEQ ID NO: 179)<br><br>>NP_003814.1 tumor necrosis factor receptor<br>superfamily member 6B precursor [Homo sapiens]<br>MRALEGPGLSLLCLVLALPALLPVPAVRGVAETPTYPWRDAETGERLVCAQCP<br>PGTFVQRPCRRDSPTTCGPCPPRHYTQFWNYLERCRYCNVLCGEREEEARACH<br>ATHNRACRCRTGFFAHAGFCLEHASCPPGAGVIAPGTPSQNTQCQPCPPGTFS<br>ASSSSSEQCQPHRNCTALGLALNVPGSSHDTLCTSCTGFPLSTRVPGAEECE<br>RAVIDFVAFQDISIKRLQRLLQALEAPEGWGPTPRAGRAALQLKLRRRLTELL<br>GAQDGALLVRLLQALRVARMPGLERSVRERFLPVH (SEQ ID NO: 180) |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| Human FasL | >NM_000639.3 *Homo sapiens* Fas ligand (FASLG), transcript variant 1, mRNA<br>AGCAGTCAGCAACAGGGTCCCGTCCTTGACACCTCAGCCTCTACAGGACTGAG<br>AAGAAGTAAAACCGTTTGCTGGGGCTGGCCTGACTCACCAGCTGCCATGCAGC<br>AGCCCTTCAATTACCCATATCCCCAGATCTACTGGGTGGACAGCAGTGCCAGC<br>TCTCCCTGGGCCCCTCCAGGCACAGTTCTTCCCTGTCCAACCTCTGTGCCCAG<br>AAGGCCTGGTCAAAGGAGGCCACCACCACCACCGCCACCGCCACCACTACCAC<br>CTCCGCCGCCGCCGCCACCACTGCCTCCACTACCGCTGCCACCCCTGAAGAAG<br>AGAGGGAACCACAGCACAGGCCTGTGTCTCCTTGTGATGTTTTTCATGGTTCT<br>GGTTGCCTTGGTAGGATTGGGCCTGGGGATGTTTCAGCTCTTCCACCTACAGA<br>AGGAGCTGGCAGAACTCCGAGAGTCTACCAGCCAGATGCACACAGCATCATCT<br>TTGGAGAAGCAAATAGGCCACCCCAGTCCACCCCCTGAAAAAAAGGAGCTGAG<br>GAAAGTGGCCCATTTAACAGGCAAGTCCAACTCAAGGTCCATGCCTCTGGAAT<br>GGGAAGACACCTATGGAATTGTCCTGCTTTCTGGAGTGAAGTATAAGAAGGGT<br>GGCCTTGTGATCAATGAAACTGGGCTGTACTTTGTATATTCCAAAGTATACTT<br>CCGGGGTCAATCTTGCAACAACCTGCCCCTGAGCCACAAGGTCTACATGAGGA<br>ACTCTAAGTATCCCCAGGATCTGGTGATGATGGAGGGGAAGATGATGAGCTAC<br>TGCACTACTGGGCAGATGTGGGCCCGCAGCAGCTACCTGGGGGCAGTGTTCAA<br>TCTTACCAGTGCTGATCATTTATATGTCAACGTATCTGAGCTCTCTCTGGTCA<br>ATTTTGAGGAATCTCAGACGTTTTTCGGCTTATATAAGCTCTAAGAGAAGCAC<br>TTTGGGATTCTTTCCATTATGATTCTTTGTTACAGGCACCGAGAATGTTGTAT<br>TCAGTGAGGGTCTTCTTACATGCATTTGAGGTCAAGTAAGAAGACATGAACCA<br>AGTGGACCTTGAGACCACAGGGTTCAAAATGTCTGTAGCTCCTCAACTCACCT<br>AATGTTTATGAGCCAGACAAATGGAGGAATATGACGGAAGAACATAGAACTCT<br>GGGCTGCCATGTGAAGAGGGAGAAGCATGAAAAAGCAGCTACCAGGTGTTCTA<br>CACTCATCTTAGTGCCTGAGAGTATTTAGGCAGATTGAAAAGGACACCTTTTA<br>ACTCACCTCTCAAGGTGGGCCTTGCTACCTCAAGGGGGACTGTCTTTCAGATA<br>CATGGTTGTGACCTGAGGATTTAAGGGATGGAAAAGGAAGACTAGAGGCTTGC<br>ATAATAAGCTAAAGAGGCTGAAAGAGGCCAATGCCCCACTGGCAGCATCTTCA<br>CTTCTAAATGCATATCCTGAGCCATCGGTGAAACTAACAGATAAGCAAGAGAG<br>ATGTTTTGGGGACTCATTTCATTCCTAACACAGCATGTGTATTTCCAGTGCAA<br>TTGTAGGGGTGTGTGTGTGTGTGTGTGTGTGTGTGTATGACTAAAGAGA<br>GAATGTAGATATTGTGAAGTACATATTAGGAAAATATGGGTTGCATTTGGTCA<br>AGATTTTGAATGCTTCCTGACAATCAACTCTAATAGTGCTTAAAAATCATTGA<br>TTGTCAGCTACTAATGATGTTTTCCTATAATATAATAAATATTTATGTAGATG<br>TGCATTTTTGTGAAATGAAAACATGTAATAAAAAGTATATGTTAGGATACAAA<br>TAA (SEQ ID NO: 181)<br><br>>NP_000630.1 tumor necrosis factor ligand superfamily member 6 isoform 1 [*Homo sapiens*]<br>MQQPFNYPYPQIYWVDSSASSPWAPPGTVLPCPTSVPRRPGQRRPPPPPPPPP<br>LPPPPPPPPLPPLPLPPLKKRGNHSTGLCLLVMFFMVLVALVGLGLGMFQLFH<br>LQKELAELRESTSQMHTASSLEKQIGHPSPPPEKKELRKVAHLTGKSNSRSMP<br>LEWEDTYGIVLLSGVKYKKGGLVINETGLYFVYSKVYFRGQSCNNLPLSHKVY<br>MRNSKYPQDLVMMEGKMMSYCTTGQMWARSSYLGAVFNLTSADHLYVNVSELS<br>LVNFEESQTFFGLYKL (SEQ ID NO: 182) |
| Mouse FasL | >NM_010177.4 *Mus musculus* Fas ligand (TNF superfamily, member 6) (Fasl), transcript variant 1, mRNA<br>TGAGGCTTCTCAGCTTCAGATGCAAGTGAGTGGGTGTCTCACAGAGAAGCAAA<br>GAGAAGAGAACAGGAGAAAGGTGTTTCCCTTGACTGCGGAAACTTTATAAAGA<br>AAACTTAGCTTCTCTGGAGCAGTCAGCGTCAGAGTTCTGTCCTTGACACCTGA<br>GTCTCCTCCACAAGGCTGTGAGAAGGAAACCCTTTCCTGGGGCTGGGTGCCAT<br>GCAGCAGCCCATGAATTACCCATGTCCCCAGATCTTCTGGGTAGACAGCAGTG<br>CCACTTCATCTTGGGCTCCTCCAGGGTCAGTTTTTCCCTGTCCATCTTGTGGG<br>CCTAGAGGGCCGGACCAAAGGAGACCGCCACCTCCACCACCACCTGTGTCACC<br>ACTACCACCGCCATCACAACCACTCCCACTGCCGCCACTGACCCCTCTAAAGA<br>AGAAGGACCACAACACAAATCTGTGGCTACCGGTGGTATTTTTCATGGTTCTG<br>GTGGCTCTGGTTGGAATGGGATTAGGAATGTATCAGCTCTTCCACCTGCAGAA<br>GGAACTGGCAGAACTCCGTGAGTTCACCAACCAAAGCCTTAAAGTATCATCTT<br>TTGAAAAGCAAATAGCCAACCCCAGTACACCCTCTGAAAAAAAAGAGCCGAGG<br>AGTGTGGCCCATTTAACAGGGAACCCCCACTCAAGGTCCATCCCTCTGGAATG<br>GGAAGACACATATGGAACCGCTCTGATCTCTGGAGTGAAGTATAAGAAGGTG<br>GCCTTGTGATCAACGAAACTGGGTTGTACTTCGTGTATTCCAAAGTATACTTC<br>CGGGGTCAGTCTTGCAACAACCAGCCCCTAAACCACAAGGTCTATATGAGGAA<br>CTCTAAGTATCCTGAGGATCTGGTGCTAATGGAGGAGAAGAGGTTGAACTACT<br>GCACTACTGGACAGATATGGGCCCACAGCAGCTACCTGGGGGCAGTATTCAAT<br>CTTACCAGTGCTGACCATTTATATGTCAACATATCTCAACTCTCTCTGATCAA<br>TTTTGAGGAATCTAAGACCTTTTTCGGCTTGTATAAGCTTTAAAAGAAAAAGC<br>ATTTTAAAATGATCTACTATTCTTTATCATGGGCACCAGGAATATTGTCTTGA<br>ATGAGAGTCTTCTTAAGACCTATTGAGATTAATTAAGACTACATGAGCCACAA<br>AGACCTCATGACCGCAAGGTCCAACAGGTCAGCTATCCTTCATTTTCTCGAGG<br>TCCATGGAGTGGTCCTTAATGCCTGCATCATGAGCCAGATGGAAGGAGGTCTG<br>TGACTGAGGGACATAAAGCTTTGGGCTGCTGTGTGACAATGCAGAGGCACAGA |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | GAAAGAACTGTCTGATGTTAAATGGCCAAGAGAATTTTAACCATTGAAGAAGA<br>CACCTTTACACTCACTTCCAGGGTGGGTCTACTTACTACCTCACAGAGGCCGT<br>TTTTGAGACATAGTTGTGGTATGAATATACAAGGGTGAGAAAGGAGGCTCATT<br>TGACTGATAAGCTAGAGACTGAAAAAAAGACAGTGTCTCATTGGCACCATCTT<br>TACTGTTACCTAATGTTTTCTGAGCCGACCTTTGATCCTAACGGAGAAGTAAG<br>AGGGATGTTTGAGGCACAAATCATTCTCTACATAGCATGCATACCTCCAGTGC<br>AATGATGTCTGTGTGTTTGTATGTATGAGAGCAAACAGATTCTAAGGAGTCAT<br>ATAAATAAAATATGTACATTATGGAGTACATATTAGAAACCTGTTACATTTGA<br>TGCTAGATATCTGAATGTTTCTTGGCAATAAACTCTAATAGTCTTCAAAATCT<br>TTTATTATCAGCTACTGATGCTGTTTTTCTTTAATCAACTAGTATTTATGCT<br>CTGAACATCCTAATGAGGAAAAGACAAATAAAATTATGTTATAGAATACAGAA<br>ATGCCTTAAGGACATAGACTTTGGAAA (SEQ ID NO: 183)<br><br>>NP_034307.1 tumor necrosis factor ligand superfamily<br>member 6 isoform 1 [Mus musculus]<br>MQQPMNYPCPQIFWVDSSATSSWAPPGSVFPCPSCGPRGPDQRRPPPPPPPVS<br>PLPPPSQPLPLPPLTPLKKKDHNTNLWLPVVFFMVLVALVGMGLGMYQLFHLQ<br>KELAELREFTNQSLKVSSFEKQIANPSTPSEKKEPRSVAHLTGNPHSRSIPLE<br>WEDTYGTALISGVKYKKGGLVINETGLYFVYSKVYFRGQSCNNQPLNHKVYMR<br>NSKYPEDLVLMEEKRLNYCTTGQIWAHSSYLGAVFNLTSADHLYVNISQLSLI<br>NFEESKTFFGLYKL (SEQ ID NO: 184) |
| Human TIM-1 (CD365) | >NM_012206.3 Homo sapiens hepatitis A virus cellular receptor 1 (HAVCR1), transcript variant 1, mRNA<br>GACCAGGAGTCAGTTTGGCGGTTATGTGTGGGGAAGAAGCTGGGAAGTCAGGG<br>GCTGTTTCTGTGGACAGCTTTCCCTGTCCTTTGGAAGGCACAGAGCTCTCAGC<br>TGCAGGGAACTAACAGAGCTCTGAAGCCGTTATATGTGGTCTTCTCTCATTTC<br>CAGCAGAGCAGGCTCATATGAATCAACCAACTGGGTGAAAAGATAAGTTGCAA<br>TCTGAGATTTAAGACTTGATCAGATACCATCTGGTGGAGGGTACCAACCAGCC<br>TGTCTGCTCATTTTCCTTCAGGCTGATCCCATAATGCATCCTCAAGTGGTCAT<br>CTTAAGCCTCATCCTACATCTGGCAGATTCTGTAGCTGGTTCTGTAAAGGTTG<br>GTGGAGAGGCAGGTCCATCTGTCACACTACCCTGCCACTACAGTGGAGCTGTC<br>ACATCCATGTGCTGGAATAGAGGCTCATGTTCTCTATTCACATGCCAAAATGG<br>CATTGTCTGGACCAATGGAACCCACGTCACCTATCGGAAGGACACACGCTATA<br>AGCTATTGGGGGACCTTTCAAGAAGGGATGTCTCTTTGACCATAGAAAATACA<br>GCTGTGTCTGACAGTGGCGTATATTGTTGCCGTGTTGAGCACCGTGGGTGGTT<br>CAATGACATGAAAATCACCGTATCATTGGAGATTGTGCCACCCAAGGTCACGA<br>CTACTCCAATTGTCACAACTGTTCCAACCGTCACGACTGTTCGAACGAGCACC<br>ACTGTTCCAACGACAACGACTGTTCCAATGACGACTGTTCCAACGACAACTGT<br>TCCAACAACAATGAGCATTCCAACGACAACGACTGTTCTGACGACAATGACTG<br>TTTCAACGACAACGAGCGTTCCAACGACAACGAGCATTCCAACAACAACAAGT<br>GTTCCAGTGACAACAACTGTCTCTACCTTTGTTCCTCCAATGCCTTTGCCCAG<br>GCAGAACCATGAACCAGTAGCCACTTCACCATCTTCACCTCAGCCAGCAGAAA<br>CCCACCCTACGACACTGCAGGGAGCAATAAGGAGAGAACCCACCAGCTCACCA<br>TTGTACTCTTACACAACAGATGGGAATGACACCGTGACGAGTCTTCAGATGG<br>CCTTTGGAATAACAATCAAACTCAACTGTTCCTAGAACATAGTCTACTGACGG<br>CCAATACCACTAAAGGAATCTATGCTGGAGTCTGTATTTCTGTCTTGGTGCTT<br>CTTGCTCTTTTGGGTGTCATCATTGCCAAAAAGTATTTCTTCAAAAAGGAGGT<br>TCAACAACTAAGTGTTTCATTTAGCAGCCTTCAAATTAAAGCTTTGCAAAATG<br>CAGTTGAAAAGGAAGTCCAAGCAGAAGACAATATCTACATTGAGAATAGTCTT<br>TATGCCACGGACTAAGACCCAGTGGTGCTCTTTGAGAGTTTACGCCCATGAGT<br>GCAGAAGACTGAACAGACATCAGCACATCAGACGTCTTTTAGACCCCAAGACA<br>ATTTTTCTGTTTCAGTTTCATCTGGCATTCCAACATGTCAGTGATACTGGGTA<br>GAGTAACTCTCTCACTCCAAACTGTGTATAGTCAACCTCATCATTAATGTAGT<br>CCTAATTTTTTATGCTAAAACTGGCTCAATCCTTCTGATCATTGCAGTTTTCT<br>CTCAAATATGAACACTTTATAATTGTATGTTCTTTTTAGACCCCATAAATCCT<br>GTATACATCAAAGAGAA (SEQ ID NO: 185)<br><br>>NP_036338.2 hepatitis A virus cellular receptor 1<br>isoform a precursor [Homo sapiens]<br>MHPQVVILSLILHLADSVAGSVKVGGEAGPSVTLPCHYSGAVTSMCWNRGSCS<br>LFTCQNGIVWTNGTHVTYRKDTRYKLLGDLSRRDVSLTIENTAVSDSGVYCCR<br>VEHRGWFNDMKITVSLEIVPPKVTTTPIVTTVPTVTTVRTSTTVPTTTTVPMT<br>TVPTTTVPTTMSIPTTTTVLTTMTVSTTTSVPTTTSIPTTTSVPVTTTVSTFV<br>PPMPLPRQNHEPVATSPSSPQPAETHPTTLQGAIRREPTSSPLYSYTTDGNDT<br>VTESSDGLWNNNQTQLFLEHSLLTANTTKGIYAGVCISVLVLLALLGVIIAKK<br>YFFKKEVQQLSVSFSSLQIKALQNAVEKEVQAEDNIYIENSLYATD (SEQ ID NO: 186) |
| Mouse TIM-1 | >NM_134248.2 Mus musculus hepatitis A virus cellular receptor 1 (Havcr1), transcript variant 1, mRNA<br>GTCAGTACCATGAATCAGATTCAAGTCTTCATTTCAGGCCTCATACTGCTTCT<br>CCCAGGCGCTGTGGATTCTTATGTGGAAGTAAAGGGGGTGGTGGGTCACCCTG<br>TCACACTTCCATGTACTTACTCAACATATCGTGGAATCACAACGACATGTTGG<br>GGCCGAGGGCAATGCCCATCTTCTGCTTGTCAAAATACACTTATTTGGACCAA |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | TGGACATCGTGTCACCTATCAGAAGAGCAGTCGGTACAACTTAAAGGGGCATA<br>TTTCAGAAGGAGATGTGTCCTTGACGATAGAGAACTCTGTTGAGAGTGACAGT<br>GGTCTGTATTGTTGTCGAGTGGAGATTCCTGGATGGTTTAATGATCAGAAAGT<br>GACCTTTTCATTGCAAGTTAAACCAGAGATTCCCACACGTCCTCCAAGAAGAC<br>CCACAACTACAAGGCCCACAGCTACAGGAAGACCCACGACTATTTCAACAAGA<br>TCCACACATGTACCAACATCAACCAGAGTCTCTACCTCCACTCCTCCAACATC<br>TACACACACATGGACTCACAAACCAGAACCCACTACATTTTGTCCCCATGAGA<br>CAACAGCTGAGGTGACAGGAATCCCATCCCATACTCCTACAGACTGGAATGGC<br>ACTGTGACATCCTCAGGAGATACCTGGAGTAATCACACTGAAGCAATCCCTCC<br>AGGGAAGCCGCAGAAAAACCCTACTAAGGGCTTCTATGTTGGCATCTGCATCG<br>CAGCCCTGCTGCTACTGCTCCTTGTGAGCACCGTGGCTATCACCAGGTACATA<br>CTTATGAAAGGAAGTCAGCATCTCTAAGCGTGGTTGCCTTCCGTGTCTCTAA<br>GATTGAAGCTTTGCAGAACGCAGCGGTTGTGCATTCCCGAGCTGAAGACAACA<br>TCTACATTGTTGAAGATAGACCTTGAGGGGCAGAATGAGTACCAGTGGCCCTC<br>TGAGGGACCTTCTGCCTGAGATTTATAGAGACTGTCACTGATGTCATAGAGTC<br>ACACCCATTACAGCGCCAAGGCGATTTTCTGTGTTGGTTCTTCCAGCTGCAGC<br>AGAGAGGGTAACCCTCTACTGTGTATACTCAAAACTCAGATTAACATCATCCT<br>AATTTTGGTATCTGCACCACCTCCGTGTCTCTGCTCACTACAGAGATTCTCTC<br>AAACATGAACGTTTTAGAAGTTTGTGTTTCCCTTAGTCAATGTAATCATTGGT<br>AATACTATTCTATTCTTGGTTACTAAAACCATTACTAAGAGAGGGATAGGAAT<br>TAAAAGTTGGTGTGAGGGGCCTCCTGAATTTAGAAGCACTTGATTCTGTTTTA<br>TCTACTTTCTTGAAATGTTACTTCTACCCTTCCCAATGGGTAAAATCATGGGA<br>GCATGGTGCCCTCATAGATAAATAGAAGAGAGTCTATTGCTGCCAATATAGAT<br>GGTTATGCTTTCTCATAGCTCTGAAAATATGACACATTTATTATGAGGTTGAT<br>CTTAGGATAAGGATAGGTGTTTTATGTCAGGAGAGGTTATCATGGTGAATATG<br>GACCAGCAGACAGCAGTGGAGGAAAATAATGAACCAAGGGATTGAGTTCATTA<br>GTGCTAATTCTACTCCACTCCTGTCTTTATGCTCCTAAACTTACTGACTGAGC<br>TCTGAATTAGGTGCTAGGAGGAGACAATGCAGACATGAAAGGGGAAGGAGCGC<br>CTTCAGGACACAGGCTCTCTGCTGAGAGAAGTCCTATTTGCAGGTGTGATAGA<br>GGTTGGGACAATCTCTGAGTTGTAAATTTCTAATTGTCTTCAGGCCATATTTA<br>TAGTTAAATTCATTTCCGAAAGACATAGCATCTTCCCCAATGGGTCAGTTTGT<br>CAAAATCAATAAATATTTTGTTTTGCTAAGAATTAAAAAAAAAAAAAAAAAAA<br>A (SEQ ID NO: 187)<br><br>>NP_599009.2 hepatitis A virus cellular receptor 1<br>homolog isoform a precursor [Mus musculus]<br>MNQIQVFISGLILLLPGAVDSYVEVKGVVGHPVTLPCTYSTYRGITTTCWGRG<br>QCPSSACQNTLIWTNGHRVTYQKSSRYNLKGHISEGDVSLTIENSVESDSGLY<br>CCRVEIPGWFNDQKVTFSLQVKPEIPTRPPRRPTTTRPTATGRPTTISTRSTH<br>VPTSTRVSTSTPPTSTHTWTHKPEPTTFCPHETTAEVTGIPSHTPTDWNGTVT<br>SSGDTWSNHTEAIPPGKPQKNPTKGFYVGICIAALLLLLLVSTVAITRYILMK<br>RKSASLSVVAFRVSKIEALQNAAVVHSRAEDNIYIVEDRP (SEQ ID NO: 188) |
| Human PD-1 | >NM_005018.3 Homo sapiens programmed cell death 1 (PDCD1), mRNA<br>GCTCACCTCCGCCTGAGCAGTGGAGAAGGCGGCACTCTGGTGGGGCTGCTCCA<br>GGCATGCAGATCCCACAGGCGCCCTGGCCAGTCGTCTGGGCGGTGCTACAACT<br>GGGCTGGCGGCCAGGATGGTTCTTAGACTCCCCAGACAGGCCCTGGAACCCCC<br>CCACCTTCTCCCCAGCCCTGCTCGTGGTGACCGAAGGGGACAACGCCACCTTC<br>ACCTGCAGCTTCTCCAACACATCGGAGAGCTTCGTGCTAAACTGGTACCGCAT<br>GAGCCCCAGCAACCAGACGGACAAGCTGGCCGCCTTCCCCGAGGACCGCAGCC<br>AGCCCGGCCAGGACTGCCGCTTCCGTGTCACACAACTGCCCAACGGGCGTGAC<br>TTCCACATGAGCGTGGTCAGGGCCCGGCGCAATGACAGCGGCACCTACCTCTG<br>TGGGGCCATCTCCCTGGCCCCCAAGGCGCAGATCAAAGAGAGCCTGCGGGCAG<br>AGCTCAGGGTGACAGAGAGAAGGGCAGAAGTGCCCACAGCCCACCCCAGCCCC<br>TCACCCAGGCCAGCCGGCCAGTTCCAAACCCTGGTGGTTGGTGTCGTGGGCGG<br>CCTGCTGGGCAGCCTGGTGCTGCTAGTCTGGGTCCTGGCCGTCATCTGCTCCC<br>GGGCCGCACGAGGGACAATAGGAGCCAGGCGCACCGGCCAGCCCCTGAAGGAG<br>GACCCCTCAGCCGTGCCTGTGTTCTCTGTGGACTATGGGGAGCTGGATTTCCA<br>GTGGCGAGAGAAGACCCCGGAGCCCCCCGTGCCCTGTGTCCCTGAGCAGACGG<br>AGTATGCCACCATTGTCTTTCCTAGCGGAATGGGCACCTCATCCCCCGCCCGC<br>AGGGGCTCAGCTGACGGCCCTCGGAGTGCCCAGCCACTGAGGCCTGAGGATGG<br>ACACTGCTCTTGGCCCCTCTGACCGGCTTCCTTGGCCACCAGTGTTCTGCAGA<br>CCCTCCACCATGAGCCCGGGTCAGCGCATTTCCTCAGGAGAAGCAGGCAGGGT<br>GCAGGCCATTGCAGGCCGTCCAGGGGCTGAGCTGCCTGGGGGCGACCGGGGCT<br>CCAGCCTGCACCTGCACCAGGCACAGCCCCACCACAGGACTCATGTCTCAATG<br>CCCACAGTGAGCCCAGGCAGCAGGTGTCACCGTCCCCTACAGGGAGGGCCAGA<br>TGCAGTCACTGCTTCAGGTCCTGCCAGCACAGAGCTGCCTGCGTCCAGCTCCC<br>TGAATCTCTGCTGCTGCTGCTGCTGCTGCTGCCTGCGGCCCGGGGCT<br>GAAGGCGCCGTGGCCCTGCCTGACGCCCCGGAGCCTCCTGCCTGAACTTGGGG<br>GCTGGTTGGAGATGGCCTTGGAGCAGCCAAGGTGCCCCTGGCAGTGGCATCCC<br>GAAACGCCCTGGACGCAGGGCCCAAGACTGGGCACAGGAGTGGGAGGTACATG<br>GGGCTGGGGACTCCCCAGGAGTTATCTGCTCCCTGCAGGCCTAGAGAAGTTTC<br>AGGGAAGGTCAGAAGAGCTCCTGGCTGTGGTGGGCAGGGCAGGAAACCCCTCC |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | ACCTTTACACATGCCCAGGCAGCACCTCAGGCCCTTTGTGGGGCAGGGAAGCT<br>GAGGCAGTAAGCGGGCAGGCAGAGCTGGAGGCCTTTCAGGCCCAGCCAGCACT<br>CTGGCCTCCTGCCGCCGCATTCCACCCCAGCCCCTCACACCACTCGGGAGAGG<br>GACATCCTACGGTCCCAAGGTCAGGAGGGCAGGGCTGGGGTTGACTCAGGCCC<br>CTCCCAGCTGTGGCCACCTGGGTGTTGGGAGGGCAGAAGTGCAGGCACCTAGG<br>GCCCCCCATGTGCCCACCCTGGGAGCTCTCCTTGGAACCCATTCCTGAAATTA<br>TTTAAAGGGGTTGGCCGGGCTCCCACCAGGGCCTGGGTGGGAAGGTACAGGCG<br>TTCCCCCGGGGCCTAGTACCCCCGCCGTGGCCTATCCACTCCTCACATCCACA<br>CACTGCACCCCCACTCCTGGGGCAGGGCCACCAGCATCCAGGCGGCCAGCAGG<br>CACCTGAGTGGCTGGGACAAGGGATCCCCCTTCCCTGTGGTTCTATTATATTA<br>TAATTATAATTAAATATGAGAGCATGCTAA (SEQ ID NO: 189)<br><br>>NP_005009.2 programmed cell death protein 1<br>precursor [Homo sapiens]<br>MQIPQAPWPVVWAVLQLGWRPGWFLDSPDRPWNPPTFSPALLVVTEGDNATFT<br>CSFSNTSESFVLNWYRMSPSNQTDKLAAFPEDRSQPGQDCRFRVTQLPNGRDF<br>HMSVVRARRNDSGTYLCGAISLAPKAQIKESLRAELRVTERRAEVPTAHPSPS<br>PRPAGQFQTLVVGVVGGLLGSLVLLVWVLAVICSRAARGTIGARRTGQPLKED<br>PSAVPVFSVDYGELDFQWREKTPEPPVPCVPEQTEYATIVFPSGMGTSSPARR<br>GSADGPRSAQPLRPEDGHCSWPL (SEQ ID NO: 190) |
| Mouse PD-1 | >NM_008798.3 Mus musculus programmed cell death 1<br>(Pdcd1), mRNA<br>TGAGCAGCGGGGAGGAGGAGGAAGAGGAGACTGCTACTGAAGGCGACACTGCCAGG<br>GGCTCTGGGCATGTGGGTCCGGCAGGTACCCTGGTCATTCACTTGGGCTGTGC<br>TGCAGTTGAGCTGGCAATCAGGGTGGCTTCTAGAGGTCCCCAATGGGCCCTGG<br>AGGTCCCTCACCTTCTACCCAGCCTGGCTCACAGTGTCAGAGGGAGCAAATGC<br>CACCTTCACCTGCAGCTTGTCCAACTGGTCGGAGGATCTTATGCTGAACTGGA<br>ACCGCCTGAGTCCCAGCAACCAGACTGAAAAACAGGCCGCCTTCTGTAATGGT<br>TTGAGCCAACCCGTCCAGGATGCCCGCTTCCAGATCATACAGCTGCCCAACAG<br>GCATGACTTCCACATGAACATCCTTGACACACGGCGCAATGACAGTGGCATCT<br>ACCTCTGTGGGGCCATCTCCCTGCACCCCAAGGCAAAAATCGAGGAGAGCCCT<br>GGAGCAGAGCTCGTGGTAACAGAGAGAATCCTGGAGACCTCAACAAGATATCC<br>CAGCCCCTCGCCCAAACCAGAAGGCCGGTTTCAAGGCATGGTCATTGGTATCA<br>TGAGTGCCCTAGTGGGTATCCCTGTATTGCTGCTGCTGGCCTGGGCCCTAGCT<br>GTCTTCTGCTCAACAAGTATGTCAGAGGCCAGAGGAGCTGGAAGCAAGGACGA<br>CACTCTGAAGGAGGAGCCTTCAGCAGCACCTGTCCCTAGTGTGGCCTATGAGG<br>AGCTGGACTTCCAGGGACGAGAGAAGACACCAGAGCTCCCTACCGCCTGTGTG<br>CACACAGAATATGCCACCATTGTCTTCACTGAAGGGCTGGGTGCCTCGGCCAT<br>GGGACGTAGGGGCTCAGCTGATGGCCTGCAGGGTCCTCGGCCTCCAAGACATG<br>AGGATGACATTGTTCTTGGCCTCTTTGACCAGATTCTTCAGCCATTAGCATG<br>CTGCAGACCCTCCACAGAGAGCACCGGTCCGTCCCTCAGTCAAGAGGAGCATG<br>CAGGCTACAGTTCAGCCAAGGCTCCCAGGGTCTGAGCTAGCTGGAGTGACAGC<br>CCAGCGCCTGCACCAATTCCAGCACATGCACTGTTGAGTGAGAGCTCACTTCA<br>GGTTTACCACAAGCTGGGAGCAGCAGGCTTCCCGGTTTCCTATTGTCACAAGG<br>TGCAGAGCTGGGGCCTAAGCCTATGTCTCCTGAATCCTACTGTTGGGCACTTC<br>TAGGGACTTGAGACACTATAGCCAATGGCCTCTGTGGGTTCTGTGCCTGGAAA<br>TGGAGAGATCTGAGTACAGCCTGCTTTGAATGGCCCTGTGAGGCAACCCCAAA<br>GCAAGGGGTCCAGGTATACTATGGGCCCAGCACCTAAAGCCACCCTTGGGAG<br>ATGATACTCAGGTGGGAAATTCGTAGACTGGGGGACTGAACCAATCCCAAGAT<br>CTGGAAAAGTTTTGATGAAGACTTGAAAAGCTCCTAGCTTCGGGGGTCTGGGA<br>AGCATGAGCACTTACCAGGCAAAAGCTCCGTGAGCGTATCTGCTGTCCTTCTG<br>CATGCCCAGGTACCTCAGTTTTTTTCAACAGCAAGGAAACTAGGGCAATAAAG<br>GGAACCAGCAGAGCTAGAGCCACCCACACATCCAGGGGGCACTTGACTCTCC<br>CTACTCCTCCTAGGAACCAAAAGGACAAAGTCCATGTTGACAGCAGGGAAGGA<br>AAGGGGGATATAACCTTGACGCAAACCAACACTGGGGTGTTAGAATCTCCTCA<br>TTCACTCTGTCCTGGAGTTGGGTTCTGGCTCTCCTTCACACCTAGGACTCTGA<br>AATGAGCAAGCACTTCAGACAGTCAGGGTAGCAAGAGTCTAGCTGTCTGGTGG<br>GCACCCAAAATGACCAGGGCTTAAGTCCCTTTCCTTTGGTTTAAGCCCGTTAT<br>AATTAAATGGTACCAAAAGCTTTAA (SEQ ID NO: 191)<br><br>>NP_032824.1 programmed cell death protein 1<br>precursor [Mus musculus]<br>MWVRQVPWSFTWAVLQLSWQSGWLLEVPNGPWRSLTFYPAWLTVSEGANATFT<br>CSLSNWSEDLMLNWNRLSPSNQTEKQAAFCNGLSQPVQDARFQIIQLPNRHDF<br>HMNILDTRRNDSGIYLCGAISLHPKAKIEESPGAELVVTERILETSTRYPSPS<br>PKPEGRFQGMVIGIMSALVGIPVLLLLAWALAVFCSTSMSEARGAGSKDDTLK<br>EEPSAAPVPSVAYEELDFQGREKTPELPTACVHTEYATIVFTEGLGASAMGRR<br>GSADGLQGPRPPRHEDGHCSWPL (SEQ ID NO: 191) |
| mScarlet | >KY021423.1 Synthetic construct mScarlet gene,<br>partial cds, mRNA<br>ATGGTGAGCAAGGGCGAGGCAGTGATCAAGGAGTTCATGCGGTTCAAGGTGCA<br>CATGGAGGGCTCCATGAACGGCCACGAGTTCGAGATCGAGGGCGAGGGCGAGG<br>GCCGCCCCTACGAGGGCACCCAGACCGCCAAGCTGAAGGTGACCAAGGGTGGC |

TABLE 1-continued

Type I Proteins of Interest Amino Acid Sequence

| Protein of Interest | Transcript Sequence (SEQ ID NO:)<br>Amino Acid Sequence (SEQ ID NO:) |
|---|---|
| | CCCCTGCCCTTCTCCTGGGACATCCTGTCCCCTCAGTTCATGTACGGCTCCAG<br>GGCCTTCACCAAGCACCCCGCCGACATCCCCGACTACTATAAGCAGTCCTTCC<br>CCGAGGGCTTCAAGTGGGAGCGCGTGATGAACTTCGAGGACGGCGGCGCCGTG<br>ACCGTGACCCAGGACACCTCCCTGGAGGACGGCACCCTGATCTACAAGGTGAA<br>GCTCCGCGGCACCAACTTCCCTCCTGACGGCCCCGTAATGCAGAAGAAGACAA<br>TGGGCTGGGAAGCGTCCACCGAGCGGTTGTACCCCGAGGACGGCGTGCTGAAG<br>GGCGACATTAAGATGGCCCTGCGCCTGAAGGACGGCGGCCGCTACCTGGCGGA<br>CTTCAAGACCACCTACAAGGCCAAGAAGCCCGTGCAGATGCCCGGCGCCTACA<br>ACGTCGACCGCAAGTTGGACATCACCTCCCACAACGAGGACTACACCGTGGTG<br>GAACAGTACGAACGCTCCGAGGGCCGCCACTCCACCGGCGGCATGGACGAGCT<br>GTACAAG (SEQ ID NO: 192)<br><br>>APD76535.1 mScarlet, partial [synthetic construct]<br>MVSKGEAVIKEFMRFKVHMEGSMNGHEFEIEGEGEGRPYEGTQTAKLKVTKGG<br>PLPFSWDILSPQFMYGSRAFTKHPADIPDYYKQSFPEGFKWERVMNFEDGGAV<br>TVTQDTSLEDGTLIYKVKLRGTNFPPDGPVMQKKTMGWEASTERLYPEDGVLK<br>GDIKMALRLKDGGRYLADFKTTYKAKKPVQMPGAYNVDRKLDITSHNEDYTVV<br>EQYERSEGRHSTGGMDELYK (SEQ ID NO: 193) |
| Nanoluciferase | >JQ513379.1 NanoLuc reporter vector<br>pNL1.1.CMV[Nluc/CMV], complete sequence, mRNA<br>GGCCTAACTGGCCTCAATATTGGCCATTAGCCATATTATTCATTGGTTATATA<br>GCATAAATCAATATTGGCTATTGGCCATTGCATACGTTGTATCTATATCATAA<br>TATGTACATTTATATTGGCTCATGTCCAATATGACCGCCATGTTGGCATTGAT<br>TATTGACTAGTTATTAATAGTAATCAATTACGGGGTCATTAGTTCATAGCCCA<br>TATATGGAGTTCCGCGTTACATAACTTACGGTAAATGGCCCGCCTGGCTGACC<br>GCCCAACGACCCCCGCCCATTGACGTCAATAATGACGTATGTTCCCATAGTAA<br>CGCCAATAGGGACTTTCCATTGACGTCAATGGGTGGAGTATTTACGGTAAACT<br>GCCCACTTGGCAGTACATCAAGTGTATCATATGCCAAGTCCGCCCCCTATTGA<br>CGTCAATGACGGTAAATGGCCCGCCTGGCATTATGCCCAGTACATGACCTTAC<br>GGGACTTTCCTACTTGGCAGTACATCTACGTATTAGTCATCGCTATTACCATG<br>GTGATGCGGTTTTGGCAGTACACCAATGGGCGTGGATAGCGGTTTGACTCACG<br>GGGATTTCCAAGTCTCCACCCCATTGACGTCAATGGGAGTTTGTTTTGGCACC<br>AAAATCAACGGGACTTTCCAAAATGTCGTAATAACCCCGCCCCGTTGACGCAA<br>ATGGGCGGTAGGCGTGTACGGTGGGAGGTCTATATAAGCAGAGCTCGTTTAGT<br>GAACCGTCAGATCACTAGAAGCTTTATTGCGGTAGTTTATCACAGTTAAATTG<br>CTAACGCAGTCAGTGGGCCTCGGCGGCCAAGCTTGGCAATCCGGTACTGTTGG<br>TAAAGCCACCATGGTCTTCACACTCGAAGATTTCGTTGGGGACTGGCGACAGA<br>CAGCCGGCTACAACCTGGACCAAGTCCTTGAACAGGGAGGTGTGTCCAGTTTG<br>TTTCAGAATCTCGGGGTGTCCGTAACTCCGATCCAAAGGATTGTCCTGAGCGG<br>TGAAAATGGGCTGAAGATCGACATCCATGTCATCATCCCGTATGAAGGTCTGA<br>GCGGCGACCAAATGGGCCAGATCGAAAAAATTTTTAAGGTGGTGTACCCTGTG<br>GATGATCATCACTTTAAGGTGATCCTGCACTATGGCACACTGGTAATCGACGG<br>GGTTACGCCGAACATGATCGACTATTTCGGACGGCCGTATGAAGGCATCGCCG<br>TGTTCGACGGCAAAAAGATCACTGTAACAGGGACCCTGTGGAACGGCAACAAA<br>ATTATCGACGAGCGCCTGATCAACCCCGACGGCTCCCTGCTGTTCCGAGTAAC<br>CATCAACGGAGTGACCGGCTGGCGGCTGTGCGAACGCATTCTGGCGTAATTCT<br>AGAGTCGGGGCGGCCGGCCGCTTCGAGCAGACATGATAAGATACATTGATGAG<br>TTTGGACAAACCACAACTAGAATGCAGTGAAAAAAATGCTTTATTTGTGAAAT<br>TTGTGATGCTATTGCTTTATTTGTAACCATTATAAGCTGCAATAAACAAGTTA<br>ACAACAACAATTGCATTCATTTTATGTTTCAGGTTCAGGGGGAGGTGTGGGAG<br>GTTTTTTAAAGCAAGTAAAACCTCTACAAATGTGGTAAAATCGATAAGGATCC<br>GTCGACCGATGCCCTTGAGAGCCTTCAACCCAGTCAGCTCCTTCCGGTGGGCG<br>CGGGGCATGACTATCGTCGCCGCACTTATGACTGTCTTCTTTATCATGCAACT<br>CGTAGGACAGGTGCCGGCAGCGCTCTTCCGCTTCCTCGCTCACTGACTCGCTG<br>CGCTCGGTCGTTCGGCTGCGGCGAGCGGTATCAGCTCACTCAAAGGCGGTAAT<br>ACGGTTATCCACAGAATCAGGGGATAACGCAGGAAAGAACATGTGAGCAAAAG<br>GCCAGCAAAAGGCCAGGAACCGTAAAAAGGCCGCGTTGCTGGCGTTTTTCCAT<br>AGGCTCCGCCCCCCTGACGAGCATCACAAAAATCGACGCTCAAGTCAGAGGTG<br>GCGAAACCCGACAGGACTATAAAGATACCAGGCGTTTCCCCCTGGAAGCTCCC<br>TCGTGCGCTCTCCTGTTCCGACCCTGCCGCTTACCGGATACCTGTCCGCCTTT<br>CTCCCTTCGGGAAGCGTGGCGCTTTCTCATAGCTCACGCTGTAGGTATCTCAG<br>TTCGGTGTAGGTCGTTCGCTCCAAGCTGGGCTGTGTGCACGAACCCCCCGTTC<br>AGCCCGACCGCTGCGCCTTATCCGGTAACTATCGTCTTGAGTCCAACCCGGTA<br>AGACACGACTTATCGCCACTGGCAGCAGCCACTGGTAACAGGATTAGCAGAGC<br>GAGGTATGTAGGCGGTGCTACAGAGTTCTTGAAGTGGTGGCCTAACTACGGCT<br>ACACTAGAAGAACAGTATTTGGTATCTGCGCTCTGCTGAAGCCAGTTACCTTC<br>GGAAAAAGAGTTGGTAGCTCTTGATCCGGCAAACAAACCACCGCTGGTAGCGG<br>TGGTTTTTTTGTTTGCAAGCAGCAGATTACGCGCAGAAAAAAAGGATCTCAAG<br>AAGATCCTTTGATCTTTTCTACGGGGTCTGACGCTCAGTGGAACGAAAACTCA<br>CGTTAAGGGATTTTGGTCATGAGATTATCAAAAAGGATCTTCACCTAGATCCT<br>TTTAAATTAAAAATGAAGTTTTAAATCAATCTAAAGTATATATGAGTAAACTT<br>GGTCTGACAGCGGCCGCAAATGCTAAACCACTGCAGTGGTTACCAGTGCTTGA<br>TCAGTGAGGCACCGATCTCAGCGATCTGCCTATTTCGTTCGTCCATAGTGGCC<br>TGACTCCCCGTCGTGTAGATCACTACGATTCGTGAGGGCTTACCATCAGGCCC |

TABLE 1-continued

Type I Proteins of Interest Amino Acid Sequence

| Protein of Interest | Transcript Sequence (SEQ ID NO:) Amino Acid Sequence (SEQ ID NO:) |
|---|---|
| | CAGCGCAGCAATGATGCCGCGAGAGCCGCGTTCACCGGCCCCCGATTTGTCAG<br>CAATGAACCAGCCAGCAGGGAGGGCCGAGCGAAGAAGTGGTCCTGCTACTTTG<br>TCCGCCTCCATCCAGTCTATGAGCTGCTGTCGTGATGCTAGAGTAAGAAGTTC<br>GCCAGTGAGTAGTTTCCGAAGAGTTGTGGCCATTGCTACTGGCATCGTGGTAT<br>CACGCTCGTCGTTCGGTATGGCTTCGTTCAACTCTGGTTCCCAGCGGTCAAGC<br>CGGGTCACATGATCACCCATATTATGAAGAAATGCAGTCAGCTCCTTAGGGCC<br>TCCGATCGTTGTCAGAAGTAAGTTGGCCGCGGTGTTGTCGCTCATGGTAATGG<br>CAGCACTACACAATTCTCTTACCGTCATGCCATCCGTAAGATGCTTTTCCGTG<br>ACCGGCGAGTACTCAACCAAGTCGTTTTGTGAGTAGTGTATACGGCGACCAAG<br>CTGCTCTTGCCCGGCGTCTATACGGGACAACACCGCGCCACATAGCAGTACTT<br>TGAAAGTGCTCATCATCGGGAATCGTTCTTCGGGGCGGAAAGACTCAAGGATC<br>TTGCCGCTATTGAGATCCAGTTCGATATAGCCCACTCTTGCACCCAGTTGATC<br>TTCAGCATCTTTTACTTTCACCAGCGTTTCGGGGTGTGCAAAAACAGGCAAGC<br>AAAATGCCGCAAAGAAGGGAATGAGTGCGACACGAAAATGTTGGATGCTCATA<br>CTCGTCCTTTTTCAATATTATTGAAGCATTTATCAGGGTTACTAGTACGTCTC<br>TCAAGGATAAGTAAGTAATATTAAGGTACGGGAGGTATTGGACAGGCCGCAAT<br>AAAATATCTTTATTTTCATTACATCTGTGTGTTGGTTTTTTGTGTGAATCGAT<br>AGTACTAACATACGCTCTCCATCAAAACAAAACGAAACAAAACAAACTAGCAA<br>AATAGGCTGTCCCCAGTGCAAGTGCAGGTGCCAGAACATTTCTCT (SEQ ID NO: 194)<br><br>>AFJ15599.1 NanoLuc luciferase [NanoLuc reporter vector pNL1.1.CMV[Nluc/CMV]]<br>MVFTLEDFVGDWRQTAGYNLDQVLEQGGVSSLFQNLGVSVTPIQRIVLSGENG<br>LKIDIHVIIPYEGLSGDQMGQIEKIFKVVYPVDDHHFKVILHYGTLVIDGVTP<br>NMIDYFGRPYEGIAVFDGKKITVTGTLWNGNKIIDERLINPDGSLLFRVTING<br>VTGWRLCERILA (SEQ ID NO: 195) |

The polypeptides provided in Table 1 above are involved in a range of biological processes, including but not limited to, suppressing the adaptive arm of the immune system (e.g., PD-L1); cellular adhesion (e.g., nectin), immune activation (e.g., HVEM), and the like. The POI domains can also be used to track, purify, or identify the engineered EVs from native EVs (e.g., mScarlet and nanoluciferase). The genes, transcripts, polypeptides, variants, and fragments thereof can be used in any combination from Table 1 to be expressed by an engineered EV provided herein. In some embodiments, the POI domain is the human polypeptide. In some embodiments, the POI domain is a homologue of the human polypeptide (e.g., mouse).

In some embodiments of any of the aspects, the engineered cell or EV provided herein comprises an exogenous nucleic acid encoding one or more exogenous polypeptide(s) selected from the group consisting of: the polypeptides listed in Table 1.

In some embodiments of any of the aspects, the POI domain is PD-L1 or a fragment thereof. In some embodiments of any of the aspects, the POI domain is PD-L2 or a fragment thereof. In some embodiments of any of the aspects, the POI domain is FGL1 or a fragment thereof. In some embodiments of any of the aspects, the POI domain is 4-1BBL or a fragment thereof. In some embodiments of any of the aspects, the POI domain is CTLA or a fragment thereof.

In some embodiments of any of the aspects, the POI domain substantially binds to one or more of a target polypeptide. In some embodiments of any of the aspects, the target polypeptide is a cellular receptor. In some embodiments of any of the aspects, the target polypeptide is an immunosuppressive polypeptide. In some embodiments of any of the aspects, the target polypeptide is an immunostimulatory polypeptide. The engineered exosomes provided herein can be designed to activate, block, or modulate a given target polypeptide with the appropriate POI domain that binds to or modulates the function or expression of the target polypeptide. Non-limiting examples of target polypeptides include those listed in Table 2 (below).

TABLE 2

Exemplary Target Polypeptides

| | | | |
|---|---|---|---|
| PD-1 | VISTA | LAG-3 | CD44 |
| CD80 | BTLA | CD112 | IL10RA |
| CD86 | CD160 | CD200R | IL10RB |
| CD28 | HVEM | CD200 | Tim-3 |
| ICOS | CD2 | Galectin 9 | TNFRSF25 |
| CD28H | SLAM CD150 | TIM-3 | TNFRSF6B |
| PD-Ll | CD58 | CD226 | CD113 |
| CTLA-4 | TIM-1 | CD155 | CD27 |
| 4-1BB (CD137) | TIM-4 | CD112 | CD30 |
| GITR | CD40 | DR3 | LFA-3 (CD58) |
| CD27L | CD30L | GITRL | CD40L |
| CD48 | CD244 | DcR3 | CD28H |
| LFA-3 (CD58) | CD98 | TNF Receptor Superfamily members | TNF receptor associated factor (TRAF) family members |
| Butyrophilin family members | PD-L2 | Nectin | TIM family members |
| B7/CD28 family members | SLAM family members | Nectin-like binding receptors | Collagen family proteins |
| LAIR-1 (CD305) | | | |

The EVs provided herein further comprise at least one fusion protein comprising a vesicle targeting domain. In various embodiments, the vesicle targeting domain provided herein is capable of binding or anchoring the fusion polypeptide provided herein to an extracellular vesicle, e.g., via targeting of the phospholipid bilayer membrane. In various embodiments, the vesicle targeting domain is a GPI domain (i.e., GPI linker, GPI anchor), fatty acylation site, or prenylation site. One of skill in the art can appreciate that the aforementioned refer to peptide or protein sites, wherein covalent lipid attachment supports embedding of the lipid in a cell membrane (i.e., phospholipid bilayer). Biochemical forces that anchor EV targeting domains to the EV phospholipid bilayer may include, but are not limited to, electrostatic forces, affinity for EVs through protein-protein interactions with natively resident proteins (e.g., CD81, CD63, CD9, ALIX, TSG101, CD98, CD298, MARCKS, PTGFRN, Lactadherin (MFGe8)), association or affinity for negatively or positively curved phospholipids, association or affinity for negatively or positively charged domains of resident membrane associated proteins, etc., or the like.

Additional non-limiting examples of membrane targeting domains that can be used and their properties are further described in detail, e.g., Alberts B, Johnson A, Lewis J, et al., Molecular Biology of the Cell, 4th edition, New York: Garland Science, 2002. Membrane Proteins, https://www.ncbi.nlm.nih.gov/books/NBK26878/; Marilyn D. Resh, Fatty acylation of proteins: new insights into membrane targeting of myristoylated and palmitoylated proteins. Biochimica et Biophysica Acta (BBA)—Molecular Cell Research. Volume 1451, Issue 1, 12 Aug. 1999, Pages 1-16, doi.org/10.1016/S0167-4889(99)00075-0; Ann Apolloni, et. al., H-ras but Not K-ras Traffics to the Plasma Membrane through the Exocytic Pathway, Molecular and Cellular Biology April 2000, 20 (7) 2475-2487, DOI: 10.1128/MCB.20.7.2475-2487.2000; Rosie Dawaliby et. al., Phosphatidylethanolamine Is a Key Regulator of Membrane Fluidity in Eukaryotic Cells, Membrane Biology, VOLUME 291, ISSUE 7, doi.org/10.1074/jbc.M115.706523; R. J. Deschenes, Protein Palmitoylation, Encyclopedia of Biological Chemistry (Second Edition), Academic Press, 2013, Pages 645-647, ISBN 9780123786319, https://doi.org/10.1016/B978-0-12-378630-2.00022-0; Charuta C. Palsuledesai and Mark D. Distefano, Protein Prenylation: Enzymes, Therapeutics, and Biotechnology Applications, ACS Chemical Biology 2015 10 (1), 51-62, DOI: 10.1021/cb500791f; Hung M E, Leonard J N. Stabilization of exosome-targeting peptides via engineered glycosylation, J Biol Chem, 2015 Mar. 27; 290(13):8166-72, doi: 10.1074/jbc.M114.621383; Udenwobele Daniel Ikenna, et. al., Myristoylation: An Important Protein Modification in the Immune Response, Frontiers in Immunology, Vol:8, 2017, DOI=10.3389/fimmu.2017.00751; Kinoshita Taroh 2020Biosynthesis and biology of mammalian GPI-anchored proteins Open Biol. 10190290, http://doi.org/10.1098/rsob.190290, the contents of which are incorporated herein by reference in their entireties.

In some embodiments, the fusion polypeptide comprises one or more, two or more, three or more, four or more, five or more, or six or more vesicle targeting domains on the same polypeptide or nucleic acid construct encoding said polypeptide. For example, the fusion polypeptides provided herein can comprise PD-L1 and Glycosylphosphatidylinositol (GPI).

In some embodiments, the vesicle targeting domain is a prenylated protein. Prenylated proteins are proteins that have at least one prenylation site. Prenylation occurs when a 15-carbon or 20-carbon, farnesyl or geranylgeranyl isoprenoid, respectively, is covalently bound via a thioether bond to a cysteine at or near the carboxy terminus of a protein. In general, a prenylation site comprises an amino acid sequence CAAX, wherein C represents cysteine, A represents an aliphatic amino acid (glycine, alanine, valine, leucine, or isoleucine), and X represents alanine, methionine, serine, leucine, or glutamine.

In some embodiments, the vesicle targeting domain is a fatty acylated protein. Fatty acylated proteins are proteins that have been modified post-translationally by covalent attachment of one or more fatty acids, generally with a saturated fatty acid that comprises 14-carbon (e.g. myristic acid) via myristoylation or 16-carbons (e.g. palmitic acid) via palmitoylation. For example, proteins destined to become myristoylated begin with the amino acids Met-Gly-X-X-X followed by a serine or threonine at position 6 and lysine or arginine at position 7 and/or 8 wherein X can be any amino acid. The methionine is removed and a myristate is linked to the glycine via an amide bond. Palmitoylation herein means a posttranslational covalent attachment of fatty acids (e.g. palmitic acid) to cysteine (S-palmitoylation), serine and/or threonine (O-palmitoylation), and to the amino group of lysine (N-palmitoylation) of proteins.

Palmitoylated proteins may be acylated by attachment of a thioester linkage to a sulfhydryl group of cysteine, or via a palmitate linked to the amino group of an N-terminal cysteine. Palmitoylation sites may be present near the N- or C-terminus of a protein.

In some embodiments, the vesicle targeting domain is a glycosylphosphatidylinositol (GPI) anchor. A glycosylphosphatidylinositol (GPI) anchor ("GPI anchor") or "GPI sticky binder" are used interchangeably and refer to a means of stably anchoring a protein to an outer leaflet (e.g. exterior layer of a phospholipid bilayer) of a cell membrane. A GPI anchor comprises a glycan, a phosphoethanolamine linker, a phospholipid tail, and may be modified by various glycan sidechains. The glycan core comprises phosphoinositol, glucosamine, and mannose residues wherein said mannose residues may be modified for example with phosphoethanolamine or carbohydrates. The phosphoethanolamine is amide-bonded to the carboxyl terminus of a protein during the process of GPI attachment. In some embodiments, the vesicle targeting domain may have affinity to EV resident proteins, e.g., CD81, CD63, CD9, ALIX, TSG101, CD98, CD298, MARCKS, PTGFRN, Lactadherin (MFGe8)

Sticky binders can include a sequence for one or more myristoylation and/or palmitoylation (Myr/Palm) sites fused to a transmembrane domain from 4F2 (CD98). For example, the myristoylation sequence from the MARCKS protein may be modified to encode for one or more myristoylation and palmitoylation sites, wherein the modified MARCKS protein sequence is fused to a protein sequence of the transmembrane domain from 4F2 via a covalent peptide bond. A Myr/Palm followed by the 4F2 transmembrane domain can improve loading of the fusion proteins provided herein when compared with 4F2 transmembrane domain alone or Myr/Palm alone.

Non-limiting examples of vesicle targeting domains that enhance fusion polypeptide structure and function on the extracellular vesicles are provided in Table 3 (below).

TABLE 3

Exosome Targeting Domain

| Exosome Targeting Domain/Sticky Binder | Nucleic Acid Sequence (SEQ ID NO:) Amino Acid Sequence (SEQ ID NO:) |
|---|---|
| Human CD55 (DAF) Glycosylphosphatidylinositol (GPI) | >NM_000574.5 *Homo sapiens* CD55 molecule (Cromer blood group) (CD55), transcript variant 1, mRNA<br>CTGCTTACTGCAACTCGCTCCGGCCGCTGGGCGTAGCTGCGACTCGGCGGAGTCCCG<br>GCGGCGCGTCCTTGTTCTAACCCGGCGCGCCATGACCGTCGCGCGGCCGAGCGTGCC<br>CGCGGCGCTGCCCCTCCTCGGGGAGCTGCCCCGGCTGCTGCTGCTGGTGCTGTTGTG<br>CCTGCCGGCCGTGTGGGGTGACTGTGGCCTTCCCCCAGATGTACCTAATGCCCAGCC<br>AGCTTTGGAAGGCCGTACAAGTTTTCCCGAGGATACTGTAATAACGTACAAATGTGA<br>AGAAAGCTTTGTGAAAATTCCTGGCGAGAAGGACTCAGTGATCTGCCTTAAGGGCAG<br>TCAATGGTCAGATATTGAAGAGTTCTGCAATCGTAGCTGCGAGGTGCCAACAAGGCT<br>AAATTCTGCATCCCTCAAACAGCCTTATATCACTCAGAATTATTTTCCAGTCGGTAC<br>TGTTGTGGAATATGAGTGCCGTCCAGGTTACAGAAGAGAACCTTCTCTATCACCAAA<br>ACTAACTTGCCTTCAGAATTTAAAATGGTCCACAGCAGTCGAATTTTGTAAAAGAA<br>ATCATGCCCTAATCCGGGAGAAATACGAAATGGTCAGATTGATGTACCAGGTGGCAT<br>ATTATTTGGTGCAACCATCTCCTTCTCATGTAACACAGGGTACAAATTATTTGGCTC<br>GACTTCTAGTTTTTGTCTTATTTCAGGCAGCTCTGTCCAGTGGAGTGACCCGTTGCC<br>AGAGTGCAGAGAAATTTATTGTCCAGCACCACCACAAATTGACAATGGAATAATTCA<br>AGGGGAACGTGACCATTATGGATATAGACAGTCTGTAACGTATGCATGTAATAAAGG<br>ATTCACCATGATTGGAGAGCACTCTATTTATTGTACTGTGAATAATGATGAAGGAGA<br>GTGGAGTGGCCCACCACCTGAATGCAGAGGAAAATCTCTAACTTCCAAGGTCCCACC<br>AACAGTTCAGAAACCTACCACAGTAAATGTTCCAACTACAGAAGTCTCACCAACTTC<br>TCAGAAAACCACCACAAAAACCACCACACCAAATGCTCAAGCAACACGGAGTACACC<br>TGTTTCCAGGACAACCAAGCATTTTCATGAAACAACCCCAAATAAAGGAAGTGGAAC<br>CACTTCAGGTACTACCCGTCTTCTATCTGGGCAGACGTGTTTCACGTTGACAGGTTT<br>GCTTGGGACGCTAGTAACCATGGGCTTGCTGACTTAGCCAAAGAAGAGTTAAGAAGA<br>AAATACACACAAGTATACAGACTGTTCCTAGTTTCTTAGACTTATCTGCATATTGGA<br>TAAAATAAATGCAATTGTGCTCTTCATTTAGGATGCTTTCATTGTCTTTAAGATGTG<br>TTAGGAATGTCAACAGAGCAAGGAGAAAAAAGGCAGTCCTGGAATCACATTCTTAGC<br>ACACCTACACCTCTTGAAAATAGAACAACTTGCAGAATTGAGAGTGATTCCTTTCCT<br>AAAAGTGTAAGAAAGCATAGAGATTTGTTCGTATTTAGAATGGGATCACGAGGAAAA<br>GAGAAGGAAAGTGATTTTTTTCCACAAGATCTGTAATGTTATTTCCACTTATAAAGG<br>AAATAAAAAATGAAAAACATTATTTGGATATCAAAAGCAAATAAAAACCCAATTCAG<br>TCTCTTCTAAGCAAAATTGCTAAAGAGAGATGAACCACATTATAAAGTAATCTTTGG<br>CTGTAAGGCATTTTCATCTTTCCTTCGGGTTGGCAAAATATTTTAAAGGTAAAACAT<br>GCTGGTGAACCAGGGGTGTTGATGGTGATAAGGGAGGAATATAGAATGAAAGACTGA<br>ATCTTCCTTTGTTGCACAAATAGAGTTTGGAAAAAGCCTGTGAAAGGTGTCTTCTTT<br>GACTTAATGTCTTTAAAAGTATCCAGAGATACTACAATATTAACATAAGAAAAGATT<br>ATATATTATTTCTGAATCGAGATGTCCATAGTCAAATTTGTAAATCTTATTCTTTTG<br>TAATATTTATTTATATTTATTTATGACAGTGAACATTCTGATTTTACATGTAAAACA<br>AGAAAAGTTGAAGAAGATATGTGAAGAAAAATGTATTTTTCCTAAATAGAAATAAAT<br>GATCCCATTTTTTGGTATCATGTAGTATGTGAAATTTATTCTTAAACGTGACTACTT<br>TATTTCTAAATAAGAAATTCCCTACCTGCTTCCTACAAGCAGTTCAGAATGCCATGC<br>CTTGGTTGTCCTAGTGTGAATAATTTTCAGCTACTTTAAAATTATATTGTACTTTCT<br>CAAGCATGTCATATCCTTTCCTATTAGAGTATCTATATTACTTGTTACTGATTTACC<br>TGAAGGCAATCTGATTAATTTCTAGGTTTTTACCATATTCTTGTCATCTTGCCAATT<br>ACATTTTAAGTGTTAGACTAGACTAAGATGTACTAGTTGTATAGAATATAACTAGA<br>TTTATTATGGCAATGTTTATTTTGTCATTTTGCTTCATCTGTTTTGTTGTTGAAGTA<br>CTTTAAATTTCATACGTTCATGGCATTTCACTGTAAAGACTTTAATGTGTATTTCTT<br>AAAATAAAACTTTTTTTCCTCCTTAA (SEQ ID NO: 196)<br>>NP_000565.1 complement decay-accelerating factor isoform 1 preproprotein [*Homo sapiens*]<br>MTVARPSVPAALPLLGELPRLLLLVLLCLPAVWGDCGLPPDVPNAQPALEGRTSFPE<br>DTVITYKCEESFVKIPGEKDSVICLKGSQWSDIEEFCNRSCEVPTRLNSASLKQPYI<br>TQNYFPVGTVVEYECRPGYRREPSLSPKLTCLQNLKWSTAVEFCKKKSCPNPGEIRN<br>GQIDVPGGILFGATISFSCNTGYKLFGSTSSFCLISGSSVQWSDPLPECREIYCPAP<br>PQIDNGIIQGERDHYGYRQSVTYACNKGFTMIGEHSIYCTVNNDEGEWSGPPPECRG<br>KSLTSKVPPTVQKPTTVNVPTTEVSPTSQKTTTKTTTPNAQATRSTPVSRTTKHFHE<br>TTPNKGSGTTSGTTRLLSGHTCFTLTGLLGTLVTMGLLT (SEQ ID NO: 197) |
| Human CD59 Glycosylphosphatidylinositol (GPI) | >NM_203330.2 *Homo sapiens* CD59 molecule (CD59 blood group) (CD59), transcript variant 1, mRNA<br>GGGGCCGGGGGGCGGAGCCTTGCGGGCTGGAGCGAAAGAATGCGGGGGCTGA<br>GCGCAGAAGCGGCTCGAGGCTGGAAGAGGATCTTGGGCGCCGCCAGTCTCTC<br>TCTGTTGCCCAAGCTGGAGTGCAGTGGCACAGTCTTGGCTCACTGCAACCTC<br>CACCTCCTGGGTGCAAGCGATTCTCGTGTCTCAGCCTCTCAAGTAGCTGGGA<br>TTACAGTCTTTAGCACCAGTTGGTGTAGGAGTTGAGACCTACTTCACAGTAG<br>TTCTGTGGACAATCACAATGGGAATCCAAGGAGGGTCTGTCCTGTTCGGGCT<br>GCTGCTCGTCCTGGCTGTCTTCTGCCATTCAGGTCATAGCCTGCAGTGCTAC<br>AACTGTCCTAACCCAACTGCTGACTGCAAAACAGCCGTCAATTGTTCATCTG<br>ATTTTGATGCGTGTCTCATTACCAAAGCTGGGTTACAAGTGTATAACAAGTG<br>TTGGAAGTTTGAGCATTGCAATTTCAACGACGTCACAACCCGCTTGAGGGAA<br>AATGAGCTAACGTACTACTGCTGCAAGAAGGACCTGTGTAACTTTAACGAAC<br>AGCTTGAAAATGGTGGGACATCCTTATCAGAGAAAACAGTTCTTCTGCTGGT<br>GACTCCATTTCTGGCAGCAGCCTGGAGCCTTCATCCCTAAGTCAACACCAGG<br>AGAGCTTCTCCCAAACTCCCCGTTCCTGCGTAGTCCGCTTTCTCTTGCTGCC |

TABLE 3-continued

Exosome Targeting Domain

| Exosome Targeting Domain/Sticky Binder | Nucleic Acid Sequence (SEQ ID NO:)<br>Amino Acid Sequence (SEQ ID NO:) |
|---|---|
| | ACATTCTAAAGGCTTGATATTTTCCAAATGGATCCTGTTGGGAAAGAATAAA<br>ATTAGCTTGAGCAACCTGGCTAAGATAGAGGGGCTCTGGGAGACTTTGAAGA<br>CCAGTCCTGTTTGCAGGGAAGCCCCACTTGAAGGAAGAAGTCTAAGAGTGAA<br>GTAGGTGTGACTTGAACTAGATTGCATGCTTCCTCCTTTGCTCTTGGGAAGA<br>CCAGCTTTGCAGTGACAGCTTGAGTGGGTTCTCTGCAGCCCTCAGATTATTT<br>TTCCTCTGGCTCCTTGGATGTAGTCAGTTAGCATCATTAGTACATCTTTGGA<br>GGGTGGGGCAGGAGTATATGAGCATCCTCTCTCACATGGAACGCTTTCATAA<br>ACTTCAGGGATCCCGTGTTGCCATGGAGGCATGCCAAATGTTCCATATGTGG<br>GTGTCAGTCAGGGACAACAAGATCCTTAATGCAGAGCTAGAGGACTTCTGGC<br>AGGGAAGTGGGGAAGTGTTCCAGATAGCAGGGCATGAAAACTTAGAGAGGTA<br>CAAGTGGCTGAAAATCGAGTTTTTCCTCTGTCTTTAAATTTTATATGGGCTT<br>TGTTTATCTTCCACTGGAAAAGTGTAATAGCATACATCAATGGTGTGTTAAAG<br>CTATTTCCTTGCCTTTTTTTTATTGGAATGGTAGGATATCTTGGCTTTGCCA<br>CACACAGTTACAGAGTGAACACTCTACTACATGTGACTGGCAGTATTAAGTG<br>TGCTTATTTTAAATGTTACTGGTAGAAAGGCAGTTCAGGTATGTGTGTATAT<br>AGTATGAATGCAGTGGGGACACCCTTTGTGGTTACAGTTTGAGACTTCCAAA<br>GGTCATCCTTAATAACAACAGATCTGCAGGGGTATGTTTTACCATCTGCATC<br>CAGCCTCCTGCTAACTCCTAGCTGACTCAGCATAGATTGTATAAAATACCTT<br>TGTAACGGCTCTTAGCACACTCACAGATGTTTGAGGCTTTCAGAAGCTCTTC<br>TAAAAAATGATACACACCTTTCACAAGGGCAAACTTTTTCCTTTTCCCTGTG<br>TATTCTAGTGAATGAATCTCAAGATTCAGTAGACCTAATGACATTTGTATTT<br>TATGATCTTGGCTGTATTTAATGGCATAGGCTGACTTTTGCAGATGGAGGAA<br>TTTCTTGATTAATGTTGAAAAAAAACCCTTGATTATACTCTGTTGGACAAAC<br>CGAGTGCAATGAATGATGCTTTTCTGAAAATGAAATATAACAAGTGGGTGAA<br>TGTGGTTATGGCCGAAAAGGATATGCAGTATGCTTAATGGTAGCAACTGAAA<br>GAAGACATCCTGAGCAGTGCCAGCTTTCTTCGTTGATGCCGTTCCCTGAAC<br>ATAGGAAAATAGAAACTTGCTTATCAAAACTTAGCATTACCTTGGTGCTCTG<br>TGTTCTCTGTTAGCTCAGTGTCTTTCCTTACATCAATAGGTTTTTTTTTTTT<br>TTTTTGGCCTGAGGAAGTACTGACCATGCCCACAGCCACCGGCTGAGCAAAG<br>AAGCTCATTTCATGTGAGTTCTAAGGAATGAGAAACAATTTTGATGAATTTA<br>AGCAGAAAATGAATTTCTGGGAACTTTTTGGGGGCGGGGGGTGGGGAATT<br>CAGCCACACTCCAGAAAGCCAGGAGTCGACAGTTTTGGAAGCCTCTCTCAGG<br>ATTGAGATTCTAGGATGAGATTGGCTTACTGCTATCTTGTGTCATGTACCCA<br>CTTTTTGGCCAGACTACACTGGGAAGAAGGTAGTCCTCTAAAGCAAAATCTG<br>AGTGCCACTAAATGGGGAGATGGGGCTGTTAAGCTGTCCAAATCAACAAGGG<br>TCATATAAATGGCCTTAAACTTTGGGGTTGCTTTCTGCAAAAAGTTGCTGTG<br>ACTCATGCCATAGACAAGGTTGAGTGCCTGGACCCAAAGGCAATACTGTAAT<br>GTAAAGACATTTATAGTACTAGGCAAACAGCACCCCAGGTACTCCAGGCCCT<br>CCTGGCTGGAGAGGGCTGTGGCAATAGAAAATTAGTGCCAACTGCAGTGAGT<br>CAGCCTAGGTTAAATAGAGAGTGTAAGAGTGCTGGACAGGAACCTCCACCCT<br>CATGTCACATTTCTTCAATGTGACCCTTCTGGCCCCTCTCCTCCTGACAGCG<br>GAACAATGACTGCCCCGATAGGTGAGGCTGGAGGAAGAATCAGTCCTGTCCT<br>TGGCAAGCTCTTCACTATGACAGTAAAGGCTCTCTGCCTGCTGCCAAGGCCT<br>GTGACTTTCTAACCTGGCCTCACGCTGGGTAAGCTTAAGGTAGAGGTGCAGG<br>ATTAGCAAGCCCACCTGGCTACCAGGCCGACAGCTACATCCTCCAACTGACC<br>CTGATCAACGAAGAGGGATTCATGTGTCTGTCTCAGTTGGTTCCAAATGAAA<br>CCAGGGAGCAGGGGAGTTAGGAATCGAACACCAGTCATGCCTACTGGCTCTC<br>TGCTCGAGAGCCAATACCCTGTGCCCTCCACTCATCTGGATTTACAGGAACT<br>GTCATAGTGTTCAGTATTGGGTGGTGATAAGCCCATTGGATTGTCCCCTTGG<br>GGGGATGAGCTAGGGGTGCAAGGAACACCTGATGAGTAGATAAGTGGAGCTC<br>ATGGTATTTCCTGAAAGATGCTAATCTATTTGCCAAACTTGGTCTTGAATGT<br>ACTGGGGGCTTCAAGGTATGGGTATATTTTTCTTGTGTCCTTGCAGTTAGCC<br>CCCATGTCTTATGTGTGTCCTGAAAAAATAAGAGCCTGCCCAAGACTTTGGG<br>CCTCTTGACAGAATTAACCACTTTTATACATCTGAGTTCTCTTGGTAAGTTC<br>TTTAGCAGTGTTCAAAGTCTACTAGCTCGCATTAGTTTCTGTTGCTGCCAAC<br>AGATCTGAACTAATGCTAACAGATCCCCCTGAGGGATTCTTGATGGGCTGAG<br>CAGCTGGCTGGAGCTAGTACTGACTGACATTCATTGTGATGAGGGCAGCTTT<br>CTGGTACAGGATTCTAAGCTCTATGTTTTATATACATTTTCATCTGTACTTG<br>CACCTCACTTTACACAAGAGGAAACTATGCAAAGTTAGCTGGATCGCTCAAG<br>GTCACTTAGGTAAGTTGGCAAGTCCATGCTTCCCACTCAGCTCCTCAGGTCA<br>GCAAGTCTACTTCTCTGCCTATTTTGTATACTCTCTTTAATATGTGCCTAGC<br>TTTGGAAAGTCTAGAATGGGTCCCTGGTGCCTTTTTACTTTGAAGAAATCAG<br>TTTCTGCCTCTTTTTGGAAAAGAAAACAAAGTGCAATTGTTTTTTACTGGAA<br>AGTTACCCAATAGCATGAGGTGAACAGGACGTAGTTAGGCCTTCCTGTAAAC<br>AGAAAATCATATCAAAACACTATCTTCCCATCTGTTTCTCAATGCCTGCTAC<br>TTCTTGTAGATATTTCATTTCAGGAGAGCAGCAGTTAAACCCGTGGATTTTG<br>TAGTTAGGAACCTGGGTTCAAACCCTCTTCCACTAATTGGCTATGTCTCTGG<br>ACAAGTTTTTTTTTTTTTTTTTAAACCCTTTCTGAACTTTCACTTTCT<br>ATGTCTACCTCAAAGAATTGTTGTGAGGCTTGAGATAATGCATTTGTAAAGG<br>GTCTGCCAGATAGGAAGATGCTAGTTATGGATTTACAAGGTTGTTAAGGCTG<br>TAAGAGTCTAAAACCTACAGTGAATCACAATGCATTTACCCCCACTGACTTG<br>GACATAAGTGAAAACTAGCCAGAAGTCTCTTTTTCAAATTACTTACAGGTTA<br>TTCAATATAAAATTTTTGTAATGGATAATCTTATTTATCTAAACTAAAGCTT<br>CCTGTTTATACACACTCCTGTTATTCTGGGATAAGATAAATGACCACAGTAC |

TABLE 3-continued

Exosome Targeting Domain

| Exosome Targeting Domain/Sticky Binder | Nucleic Acid Sequence (SEQ ID NO:) Amino Acid Sequence (SEQ ID NO:) |
|---|---|
| | CTTAATTTCTAGGTGGGTGCCTGTGATGGTTCATTGTAGGTAAGGACATTTT<br>CTCTTTTTCAGCAGCTGTGTAGGTCCAGAGCCTCTGGGAGAGGAGGGGGGTA<br>GCATGCACCCAGCAGGGGACTGAACTGGGAAACTCAAGGTTCTTTTTACTGT<br>GGGGTAGTGAGCTGCCTTTCTGTGATCGGTTTCCCTAGGGATGTTGCTGTTC<br>CCCTCCTTGCTATTCGCAGCTACATACAACGTGGCCAACCCCAGTAGGCTGA<br>TCCTATATATGATCAGTGCTGGTGCTGACTCTCAATAGCCCCACCCAAGCTG<br>GCTATAGGTTTACAGATACATTAATTAGGCAACCTAAAATATTGATGCTGGT<br>GTTGGTGTGACATAATGCTATGGCCAGAACTGAAACTTAGAGTTATAATTCA<br>TGTATTAGGGTTCTCCAGAGGGACAGAATTAGTAGGATATATGTATATATGA<br>AAGGGAGGTTATTAGGGAGAACTGGCTCCCACAGTTAGAAGGCGAAGTCGCA<br>CAATAGGCCGTCTGCAAGCTGGGTTAGAGAGAAGCCAGTAGTGGCTCAGCCT<br>GAGTTCAAAAACCTCAAAACTGGGGAAGCTGACAGTGCAGCCAGCCTTCAGT<br>CTGTGGCCAAAGGCCCAAGAGCCCTGGCAACCAACCCACTGGTGCAAGTCC<br>TAGATTCCAAAGGCTGAAGAACCTGGAGTCTGATGTCCAAGAGCAGGAAGAG<br>TGGAAGAAAGCCAGAAGACTCAGCAAACAAGGTAGACAGTGTCTACCACCAT<br>AGTGGCCATACCAAAGAGGCTACCGATTCCTTCCTGCTACCTGGATCCCTGA<br>AGTTGCCCTGGTCTCTGCACCTTCTAAACCTAGTTCTTAAGAGCTTTCCATT<br>ACATGAGCTGTCTCAAAGCCCTCCAATAAATTCTCAGTGTAAGCTTCTGTTG<br>CTTGTGGACAGAAAATTCTGACAGACCTACCCTATAAGTGTTACTGTCAGGA<br>TAACATGAGAACGCACAACAGTAAGTGGTCACTAAGTGTTAGCTACGGTTAT<br>TTTGCCCAAGGTAGCATGGCTAGTTGATGCCGGTTGATGGGGCTTAAACCCA<br>GCTCCCTCATCTTCCAGGCCTCTGTACTCCCTATTCCACTAAACTACCTCTC<br>AGGTTTATTTTTTTAAATTCTTACTCTGCAAGTACATAGGACCACATTTACC<br>TGGGAAAACAAGAATAAAGGCTGCTCTGCATTTTTTAGAAACTTTTTTGAAA<br>GGGAGATGGGAATGCCTGCACCCCAAGTCCAGACCAACACAATGGTTAATT<br>GAGATGAATAATAAAGGAAAGACTGTTCTGGGCTTCCCAGAATAGCTTGGTC<br>CTTAAATTGTGGCACAAACAACCTCCTGTCAGAGCCAGCCTCCTGCCAGGAA<br>GAGGGGTAGGAGACTAGAGGCCGTGTGTGCAGCCTTGCCCTGAAGGCTAGGG<br>TGACAATTTGGAGGCTGTCCAAACACCCTGGCCTCTAGAGCTGGCCTGTCTA<br>TTTGAAATGCCGGCTCTGATGCTAATCGGCGACCCTCAGGCAAGTTACTTAA<br>CCTTACATGCCTCAGTTTTCTCATCTGGAAAATGAGAACCCTAGGTTTAGGG<br>TTGTTAGAAAAGTTAAATGAGTTAAGACAAGTGCCTGGGACACAGTAGCCTC<br>TTGTGTGTGTTTATCATTATGTCCTCAGCAGGTCGTAGAAGCAGCTTCTCAG<br>GTGTGAGGCTGGCGCGATTATCTGGAGTGGGTTGGGTTTTCTAGGATGGACC<br>CCCTGCTGCATTTTCCTCATTCATCCACCAGGGCTTAATGGGGAATCAAGGA<br>ATCCATGTGTAACTGTATAATAACTGTAGCCACACTCCAATGACCACCTACT<br>AGTTGTCCCTGGCACTGCTTATACATATGTCCATCAAATCAATCCTATGAAG<br>TAGATACTGTCTTCATTTTATAGATCAGAGACAATTGGGGTTCAGAGAGCTG<br>ATGTGATTTTCCCAGGGTCACAGAGAGTCCCAGATTCAGGCACAACTCTTGT<br>ATTCCAAGACACAACCACTACATGTCCAAAGGCTGCCCAGAGCCACCGGGCA<br>CGGCAAATTGTGACATATCCCTAAAGAGGCTGAGCACCTGGTCAGGATCTGA<br>TGGCTGACAGTGTGTCCAGATGCAGAGCTGGAGTGGGGAGGGGAAGGGGGG<br>CTCCTTGGGACAGAGAAGGCTTTCTGTGCTTTCTCTGAAGGGAGCAGTCTGA<br>GGACCAAGGGAACCCGGCAAACAGCACCTCAGGTACTCCAGGCCCTCCTGGC<br>TGGAGAGGGCTGTGGCAATGGAAAATTAGTGCCAACTGCAATGAGTCAGCCT<br>CGGTTAAATAGAGAGTGAAGAATGCTGGACAGGAACCTCCACCCTCATGTCA<br>CATTTCTTCAGTGTGACCCTTCTGGCCCCTCTCCTCCTGACAGCGGAACAAT<br>GACTGCCCCGATAGGTGAGGCTGGAGGAAGAATCAGTCCTGTCCTTGGCAAG<br>CTCTTCACTATGACAGTAAAGGCTCTCTGCCTGCTGCCAAGGCCTGTGACTT<br>TCTAACCTGGCCTCACGCTGGGTAAGCTTAAGGTAGAGGTGCAGGATTAGCA<br>AGCCCACCTGGCTACCAGGCCGACAGCTACATCTTTCAACTGACCCTGATCA<br>ACGAAGAGGGACTTGTGTCTCTCAGTTGGTTCCAAATGAAACCAGGGAGCAG<br>GGGCGTTAGGAAGCTCCAACAGGATGGTACTTAATGGGGCATTTGAGTGGAG<br>AGGTAGGTGACATAGTGCTTTGGAGCCCAGGGAGGGAAAGGTTCTGCTGAAG<br>TTGAATTCAAGACTGTTCTTTCATCACAAACTTGAGTTTCCTGGACATTTGT<br>TTGCAGAAACAACCGTAGGGTTTTGCCTTAACCTCGTGGGTTTATTATTACC<br>TCATAGGGACTTTGCCTCCTGACAGCAGTTTATGGGTGTTCATTGTGGCACT<br>TGAGTTTTCTTGCATACTTGTTAGAGAAACCAAGTTTGTCATCAACTTCTTA<br>TTTAACCCCTGGCTATAACTTCATGGATTATGTTATAATTAAGCCATCCAG<br>AGTAAAATCTGTTTAGATTATCTTGGAGTAAGGGGGAAAAAATCTGTAATTT<br>TTTCTCCTCAACTAGATATATACATAAAAAATGATTGTATTGCTTCATTTAA<br>AAAATATAACGCAAAATCTCTTTTCCTTCTAAAAAAAAAAAAAAAAA<br>(SEQ ID NO: 321)<br>>NP_976075.1 CD59 glycoprotein preproprotein [Homo sapiens]<br>MGIQGGSVLFGLLLVLAVFCHSGHSLQCYNCPNPTADCKTAVNCSSDFDACL<br>ITKAGLQVYNKCWKFEHCNFNDVTTRLRENELTYYCCKKDLCNFNEQLENGG<br>TSLSEKTVLLLVTPFLAAAWSLHP (SEQ ID NO: 198) |
| Human C1C2 from MFGE8 | NM_005928.4 *Homo sapiens* milk fat globule-EGF factor 8 protein (MFGE8), transcript variant 1, mRNA<br>AGAACCCCGCGGGGTCTGAGCAGCCCAGCGTGCCCATTCCAGCGCCCGCGTCCCCGC<br>AGCATGCCGCGCCCCCGCCTGCTGGCCGCGCTGTGCGGCGCGCTGCTCTGCGCCCCC<br>AGCCTCCTCGTCGCCCTGGATATCTGTTCCAAAAACCCCTGCCACAACGGTGGTTTA |

TABLE 3-continued

Exosome Targeting Domain

| Exosome Targeting Domain/Sticky Binder | Nucleic Acid Sequence (SEQ ID NO:)<br>Amino Acid Sequence (SEQ ID NO:) |
|---|---|
| | TGCGAGGAGATTTCCCAAGAAGTGCGAGGAGATGTCTTCCCCTCGTACACCTGCACG<br>TGCCTTAAGGGCTACGCGGGCAACCACTGTGAGACGAAATGTGTCGAGCCACTGGGC<br>CTGGAGAATGGGAACATTGCCAACTCACAGATCGCCGCCTCGTCTGTGCGTGTGACC<br>TTCTTGGGTTTGCAGCATTGGGTCCCGGAGCTGGCCCGCCTGAACCGCGCAGGCATG<br>GTCAATGCCTGGACACCCAGCAGCAATGACGATAACCCCTGGATCCAGGTGAACCTG<br>CTGCGGAGGATGTGGGTAACAGGTGTGGTGACGCAGGGTGCCAGCCGCTTGGCCAGT<br>CATGAGTACCTGAAGGCCTTCAAGGTGGCCTACAGCCTTAATGGACACGAATTCGAT<br>TTCATCCATGATGTTAATAAAAAACACAAGGAGTTTGTGGGTAACTGGAACAAAAAC<br>GCGGTGCATGTCAACCTGTTTGAGACCCCTGTGGAGGCTCAGTACGTGAGATTGTAC<br>CCCACGAGCTGCCACACGGCCTGCACTCTGCGCTTTGAGCTACTGGGCTGTGAGCTG<br>AACGGATGCGCCAATCCCCTGGGCCTGAAGAATAACAGCATCCCTGACAAGCAGATC<br>ACGGCCTCCAGCAGCTACAAGACCTGGGGCTTGCATCTCTTCAGCTGGAACCCCTCC<br>TATGCACGGCTGGACAAGCAGGGCAACTTCAACGCCTGGGTTGCGGGGAGCTACGGT<br>AACGATCAGTGGCTGCAGGTGGACCTGGGCTCCTCGAAGGAGGTGACAGGCATCATC<br>ACCCAGGGGGCCCGTAACTTTGGCTCTGTCCAGTTTGTGGCATCCTACAAGGTTGCC<br>TACAGTAATGACAGTGCGAACTGGACTGAGTACCAGGACCCCAGGACTGGCAGCAGT<br>AAGATCTTCCCTGGCAACTGGGACAACCACTCCCACAAGAAGAACTTGTTTGAGACG<br>CCCATCCTGGCTCGCTATGTGCGCATCCTGCCTGTAGCCTGGCACAACCGCATCGCC<br>CTGCGCCTGGAGCTGCTGGGCTGTTAGTGGCCACCTGCCACCCCCAGGTCTTCCTGC<br>TTTCCATGGGCCCGCTGCCTCTTGGCTTCTCAGCCCCTTTAAATCACCATAGGGCTG<br>GGGACTGGGGAAGGGGAGGGTGTTCAGAGGCAGCACCACCACACAGTCACCCCTCCC<br>TCCCTCTTTCCCACCCTCCACCTCTCACGGGCCCTGCCCCAGCCCCTAAGCCCCGTC<br>CCCTAACCCCCAGTCCTCACTGTCCTGTTTTCTTAGGCACTGAGGGATCTGAGTAGG<br>TCTGGGATGGACAGGAAAGGGCAAAGTAGGGCGTGTGGTTTCCCTGCCCCTGTCCGG<br>ACCGCCGATCCCAGGTGCGTGTGTCTCTGTCTCTCCTAGCCCCTCTCTCACACATCA<br>CATTCCCATGGTGGCCTCAAGAAAGGCCCGGAAGCGCCAGGCTGGAGATAACAGCCT<br>CTTGCCCGTCGGCCCTGCGTCGGCCCTGGGGTACCATGTGGCCACAACTGCTGTGGC<br>CCCCTGTCCCCAAGACACTTCCCCTTGTCTCCCTGGTTGCCTCTCTTGCCCCTTGTC<br>CTGAAGCCCAGCGACACAGAAGGGGGTGGGGCGGGTCTATGGGGAGAAAGGGAGCGA<br>GGTCAGAGGAGGGCATGGGTTGGCAGGGTGGGCGTTTGGGGCCCTCTATGCTGGCTT<br>TTCACCCCAGAGGACACAGGCAGCTTCCAAAATATATTTATCTTCTTCACGGGAA<br>(SEQ ID NO: 199)<br>>NP_005919.2 lactadherin isoform a preproprotein [*Homo sapiens*]<br>MPRPRLLAALCGALLCAPSLLVALDICSKNPCHNGGLCEEISQEVRGDVFPSYTCTC<br>LKGYAGNHCETKCVEPLGLENGNIANSQIAASSVRVTFLGLQHWVPELARLNRAGMV<br>NAWTPSSNDDNPWIQVNLLRRMWVTGVVTQGASRLASHEYLKAFKVAYSLNGHEFDF<br>IHDVNKKHKEFVGNWNKNAVHVNLFETPVEAQYVRLYPTSCHTACTLRFELLGCELN<br>GCANPLGLKNNSIPDKQITASSSYKTWGLHLFSWNPSYARLDKQGNFNAWVAGSYGN<br>DQWLQVDLGSSKEVTGIITQGARNFGSVQFVASYKVAYSNDSANWTEYQDPRTGSSK<br>IFPGNWDNHSHKKNLFETPILARYVRILPVAWHNRIALRLELLGC (SEQ ID NO: 200) |
| Human 4F2 (CD98) | >NM_002394.6 *Homo sapiens* solute carrier family 3 member 2 (SLC3A2), transcript variant 3, mRNA<br>GCATTGCGGCTTGGTTTTCTCACCCAGTGCATGTGGCAGGAGCGGTGAGATC<br>ACTGCCTCACGGCGATCCTGGACTGACGGTCACGACTGCCTACCCTCTAACC<br>CTGTTCTGAGCTGCCCCTTGCCCACACACCCCAAACCTGTGTGCAGGATCCG<br>CCTCCATGGAGCTACAGCCTCCTGAAGCCTCGATCGCCGTCGTGTCGATTCC<br>GCGCCAGTTGCCTGGCTCACATTCGGAGGCTGGTGTCCAGGGTCTCAGCGCG<br>GGGGACGACTCAGAGTTGGGGTCTCACTGTGTTGCCCAGACTGGTCTCGAAC<br>TCTTGGCCTCAGGTGATCCTCTTCCCTCAGCTTCCCAGAATGCCGAGATGAT<br>AGAGACGGGGTCTGACTGTGTTACCCAGGCTGGTCTTCAACTCTTGGCCTCA<br>AGTGATCCTCCTGCCTTAGCTTCCAAGAATGCTGAGGTTACAGGCACCATGA<br>GCCAGGACACCGAGGTGGATATGAAGGAGGTGGAGCTGAATGAGTTAGAGCC<br>CGAGAAGCAGCCGATGAACGCGGCGTCTGGGGCGGCCATGTCCCTGGCGGGA<br>GCCGAGAAGAATGGTCTGGTGAAGATCAAGGTGGCGGAAGACGAGGCGGAGG<br>CGGCAGCCGCGGCTAAGTTCACGGGCCTGTCCAAGGAGGAGCTGCTGAAGGT<br>GGCAGGCAGCCCCGGCTGGGTACGCACCCGCTGGGCACTGCTGCTGCTCTTC<br>TGGCTCGGCTGGCTCGGCATGCTTGCTGGTGCCGTGGTCATAATCGTGCGAG<br>CGCCGCGTTGTCGCGAGCTACCGGCGCAGAAGTGGTGGCACACGGGCGCCCT<br>CTACCGCATCGGCGACCTTCAGGCCTTCCAGGGCCACGCGCGGGCAACCTG<br>GCGGGTCTGAAGGGCGTCTCGATTACCTGAGCTCTCTGAAGGTGAAGGGCC<br>TTGTGCTGGGTCCAATTCACAAGAACCAGAAGGATGATGTCGCTCAGACTGA<br>CTTGCTGCAGATCGACCCCAATTTTGGCTCCAAGGAAGATTTTGACAGTCTC<br>TTGCAATCGGCTAAAAAAAAGAGCATCCGTGTCATTCTGGACCTTACTCCCA<br>ACTACCGGGGTGAGAACTCGTGGTTCTCCACTCAGGTTGACACTGTGGCCAC<br>CAAGGTGAAGGATGCTCTGGAGTTTTGGCTGCAAGCTGGCGTGGATGGGTTC<br>CAGGTTCGGGACATAGAGAATCTGAAGGATGCATCCTCATTCTTGGCTGAGT<br>GGCAAAATATCACCAAGGGCTTCAGTGAAGACAGGCTCTTGATTGCGGGAC<br>TAACTCCTCCGACCTTCAGCAGATCCTGAGCCTACTCGAATCCAACAAAGAC<br>TTGCTGTTGACTAGCTCATACCTGTCTGATTCTGGTTCTACTGGGGAGCATA<br>CAAAATCCCTAGTCACACAGTATTTGAATGCCACTGGCAATCGCTGGTGCAG<br>CTGGAGTTTGTCTCAGGCAAGGCTCCTGACTTCCTTCTTGCCGGCTCAACTT |

TABLE 3-continued

Exosome Targeting Domain

| Exosome Targeting Domain/Sticky Binder | Nucleic Acid Sequence (SEQ ID NO:)<br>Amino Acid Sequence (SEQ ID NO:) |
|---|---|
| | CTCCGACTCTACCAGCTGATGCTCTTCACCCTGCCAGGGACCCCTGTTTTCA<br>GCTACGGGGATGAGATTGGCCTGGATGCAGCTGCCCTTCCTGGACAGCCTAT<br>GGAGGCTCCAGTCATGCTGTGGGATGAGTCCAGCTTCCCTGACATCCCAGGG<br>GCTGTAAGTGCCAACATGACTGTGAAGGGCCAGAGTGAAGACCCTGGCTCCC<br>TCCTTTCCTTGTTCCGGCGGCTGAGTGACCAGCGGAGTAAGGAGCGCTCCCT<br>ACTGCATGGGGACTTCCACGCGTTCTCCGCTGGGCCTGGACTCTTCTCCTAT<br>ATCCGCCACTGGGACCAGAATGAGCGTTTTCTGGTAGTGCTTAACTTTGGGG<br>ATGTGGGCCTCTCGGCTGGACTGCAGGCCTCCGACCTGCCTGCCAGCGCCAG<br>CCTGCCAGCCAAGGCTGACCTCCTGCTCAGCACCCAGCCAGGCCGTGAGGAG<br>GGCTCCCCTCTTGAGCTGGAACGCCTGAAACTGGAGCCTCACGAAGGGCTGC<br>TGCTCCGCTTCCCCTACGCGGCCTGACTTCAGCCTGACATGGACCCACTACC<br>CTTCTCCTTTCCTTCCCAGGCCCTTTGGCTTCTGATTTTTCTCTTTTTTAAA<br>AACAAACAAACAAACTGTTGCAGATTATGAGTGAACCCCCAAATAGGGTGTT<br>TTCTGCCTTCAAATAAAAGTCACCCCTGCATGGTGAA (SEQ ID NO: 201)<br>>NP_002385.3 4F2 cell-surface antigen heavy chain isoform c [Homo sapiens]<br>MELQPPEASIAVVSIPRQLPGSHSEAGVQGLSAGDDSELGSHCVAQTGLELL<br>ASGDPLPSASQNAEMIETGSDCVTQAGLQLLASSDPPALASKNAEVTGTMSQ<br>DTEVDMKEVELNELEPEKQPMNAASGAAMSLAGAEKNGLVKIKVAEDEAEAA<br>AAAKFTGLSKEELLKVAGSPGWVRTRWALLLLFWLGWLGMLAGAVVIIVRAP<br>RCRELPAQKWWHTGALYRIGDLQAFQGHGAGNLAGLKGRLDYLSSLKVKGLV<br>LGPIHKNQKDDVAQTDLLQIDPNFGSKEDFDSLLQSAKKKSIRVILDLTPNY<br>RGENSWFSTQVDTVATKVKDALEFWLQAGVDGFQVRDIENLKDASSFLAEWQ<br>NITKGFSEDRLLIAGTNSSDLQQILSLLESNKDLLLTSSYLSDSGSTGEHTK<br>SLVTQYLNATGNRWCSWSLSQARLLTSFLPAQLLRLYQLMLFTLPGTPVFSY<br>GDEIGLDAAALPGQPMEAPVMLWDESSFPDIPGAVSANMTVKGQSEDPGSLL<br>SLFRRLSDQRSKERSLLHGDFHAFSAGPGLFSYIRHWDQNERFLVVLNFGDV<br>GLSAGLQASDLPASASLPAKADLLLLSTQPGREEGSPLELERLKLEPHEGLLL<br>RFPYAA (SEQ ID NO: 202) |
| Human TFR2 | >NM_003227.4 Homo sapiens transferrin receptor 2 (TFR2), transcript variant 1, mRNA<br>ATCGCTGGGGGACAGCCTGCAGGCTTCAGGAGGGGACACAAGCATGGAGCGG<br>CTTTGGGGTCTATTCCAGAGAGCGCAACAACTGTCCCCAAGATCCTCTCAGA<br>CCGTCTACCAGCGTGTGGAAGGCCCCCGGAAAGGGCACCTGGAGGAGGAAGA<br>GGAAGACGGGGAGGAGGGGCGGAGACATTGGCCCACTTCTGCCCCATGGAG<br>CTGAGGGGCCCTGAGCCCCTGGGCTCTAGACCCAGGCAGCCAAACCTCATTC<br>CCTGGGCGGCAGCAGGACGGAGGGCTGCCCCCTACCTGGTCCTGACGGCCCT<br>GCTGATCTTCACTGGGGCCTTCCTACTGGGCTACGTCGCCTTCCGAGGGTCC<br>TGCCAGGCGTGCGGAGACTCTGTGTTGGTGGTCAGTGAGGATGTCAACTATG<br>AGCCTGACCTGGATTTCCACCAGGGCAGACTCTACTGGAGCGACCTCCAGGC<br>CATGTTCCTGCAGTTCCTGGGGGAGGGGCGCCTGGAGGACACCATCAGGCAA<br>ACCAGCCTTCGGGAACGGGTGGCAGGCTCGGCCGGGATGGCCGCTCTGACTC<br>AGGACATTCGCGCGGCGCTCTCCCGCCAGAAGCTGGACCACGTGTGGACCGA<br>CACGCACTACGTGGGGCTGCAATTCCCGGATCCGGCTCACCCCAACACCCTG<br>CACTGGGTCGATGAGGCCGGGAAGGTCGGAGAGCAGCTGCCGCTGGAGGACC<br>CTGACGTCTACTGCCCCTACAGCGCCATCGGCAACGTCACGGGAGAGCTGGT<br>GTACGCCCACTACGGGCGGCCCGAAGACCTGCAGGACCTGCGGGCCAGGGGC<br>GTGGATCCAGTGGGCCGCCTGCTGCTGGTGCGCGTGGGGGTGATCAGCTTCG<br>CCCAGAAGGTGACCAATGCTCAGGACTTCGGGGCTCAAGGAGTGCTCATATA<br>CCCAGAGCCAGCGGACTTCTCCCAGGACCCACCCAAGCCAAGCCTGTCCAGC<br>CAGCAGGCAGTGTATGGACATGTGCACCTGGGAACTGGAGACCCCTACACAC<br>CTGGCTTCCCTTCCTTCAATCAAACCCAGTTCCCTCCAGTTGCATCATCAGG<br>CCTTCCCAGCATCCCAGCCCAGCCCATCAGTGCAGACATTGCCTCCCGCCTG<br>CTGAGGAAGCTCAAAGGCCCTGTGGCCCCCCAAGAATGGCAGGGGAGCCTCC<br>TAGGCTCCCCTTATCACCTGGGCCCCGGGCCACGACTGCGGCTAGTGGTCAA<br>CAATCACAGGACCTCCACCCCCATCAACAACATCTTCGGCTGCATCGAAGGC<br>CGCTCAGAGCCAGATCACTACGTTGTCATCGGGGCCCAGAGGGATGCATGGG<br>GCCCAGGAGCAGCTAAATCCGCTGTGGGACGGCTATACTCCTGGAGCTGGT<br>GCGGACCTTTTCCTCCATGGTGAGCAACGGCTTCCGGCCCCGCAGAAGTCTC<br>CTCTTCATCAGCTGGGACGGTGGTGACTTTGGAAGCGTGGGCTCCACGGAGT<br>GGCTAGAGGGCTACCTCAGCGTGCTGCACCTCAAAGCCGTAGTGTACGTGAG<br>CCTGGACAACGCAGTGCTGGGGGATGACAAGTTTCATGCCAAGACCAGCCCC<br>CTTCTGACAAGTCTCATTGAGAGTGTCCTGAAGCAGGTGGATTCTCCCAACC<br>ACAGTGGGCAGACTCTCTATGAACAGGTGGTGTTCACCAATCCCAGCTGGGA<br>TGCTGAGGTGATCCGGCCCCTACCCATGGACAGCAGTGCCTATTCCTTCACG<br>GCCTTTGTGGGAGTCCCTGCCGTCGAGTTCTCCTTTATGGAGGACGACCAGG<br>CCTACCCATTCCTGCACACAAAGGAGGACACTTATGAGAACCTGCATAAGGT<br>GCTGCAAGGCCGCCTGCCCGCTGTGGCCCAGGCCGTGGCCCAGCTCGCAGGG<br>CAGCTCCTCATCCGGCTCAGCCACGATCGCCTGCTGCCCCTCGACTTCGGCC<br>GCTACGGGGACGTCGTCCTCAGGCACATCGGGAACCTCAACGAGTTCTCTGG<br>GGACCTCAAGGCCCGCGGGCTGACCCTGCAGTGGGTGTACTCGGCGCGGGG<br>GACTACATCCGGGCGGCGGAAAAGCTGCGGCAGGAGATCTACAGCTCGGAGG<br>AGAGAGACGAGCGACTGACACGCATGTACAACGTGCGCATAATGCGGGTGGA |

TABLE 3-continued

Exosome Targeting Domain

| Exosome Targeting Domain/Sticky Binder | Nucleic Acid Sequence (SEQ ID NO:) Amino Acid Sequence (SEQ ID NO:) |
|---|---|
| | GTTCTACTTCCTTTCCCAGTACGTGTCGCCAGCCGACTCCCCGTTCCGCCAC<br>ATCTTCATGGGCCGTGGAGACCACACGCTGGGCGCCCTGCTGGACCACCTGC<br>GGCTGCTGCGCTCCAACAGCTCCGGGACCCCCGGGGCCACCTCCTCCACTGG<br>CTTCCAGGAGAGCCGTTTCCGGCGTCAGCTAGCCCTGCTCACCTGGACGCTG<br>CAAGGGGCAGCCAATGCGCTTAGCGGGGATGTCTGGAACATTGATAACAACT<br>TCTGAGGCCCTGGGGATCCTCACATCCCCGTCCCCCAGTCAAGAGCTCCTCT<br>GCTCCTCGCTTGAATGATTCAGGGTCAGGGAGGTGGCTCAGAGTCCACCTCT<br>CATTGCTGATCAATTTCTCATTACCCCTACACATCTCTCCACGGAGCCCAGA<br>CCCCAGCACAGATATCCACACACCCCAGCCCTGCAGTGTAGCTGACCCTAAT<br>GTGACGGTCATACTGTCGGTTAATCAGAGAGTAGCATCCCTTCAATCACAGC<br>CCCTTCCCCTTTCTGGGGTCCTCCATACCTAGAGACCACTCTGGGAGGTTTG<br>CTAGGCCCTGGGACCTGGCCAGCTCTGTTAGTGGGAGAGATCGCTGGCACCA<br>TAGCCTTATGGCCAACAGGTGGTCTGTGGTGAAAGGGGCGTGGAGTTTCAAT<br>ATCAATAAACCACCTGATATCAATAA (SEQ ID NO: 203)<br>>NP_003218.2 transferrin receptor protein 2 isoform<br>1 [*Homo sapiens*]<br>MERLWGLFQRAQQLSPRSSQTVYQRVEGPRKGHLEEEEEDGEEGAETLAHFC<br>PMELRGPEPLGSRPRQPNLIPWAAAGRRAAPYLVLTALLIFTGAFLLGYVAF<br>RGSCQACGDSVLVVSEDVNYEPDLDFHQGRLYWSDLQAMFLQFLGEGRLEDT<br>IRQTSLRERVAGSAGMAALTQDIRAALSRQKLDHVWTDTHYVGLQFPDPAHP<br>NTLHWVDEAGKVGEQLPLEDPDVYCPYSAIGNVTGELVYAHYGRPEDLQDLR<br>ARGVDPVGRLLLVRVGVISFAQKVTNAQDFGAQGVLIYPEPADFSQDPPKPS<br>LSSQQAVYGHVHLGTGDPYTPGFPSFNQTQFPPVASSGLPSIPAQPISADIA<br>SRLLRKLKGPVAPQEWQGSLLGSPYHLGPGPRLRLVVNNHRTSTPINNIFGC<br>IEGRSEPDHYVVIGAQRDAWGPGAAKSAVGTAILLELVRTFSSMVSNGFRPR<br>RSLLFISWDGGDFGSVGSTEWLEGYLSVLHLKAVVYVSLDNAVLGDDKFHAK<br>TSPLLTSLIESVLKQVDSPNHSGQTLYEQVVFTNPSWDAEVIRPLPMDSSAY<br>SFTAFVGVPAVEFSFMEDDQAYPFLHTKEDTYENLHKVLQGRLPAVAQAVAQ<br>LAGQLLIRLSHDRLLPLDFGRYGDVVLRHIGNLNEFSGDLKARGLTLQWVYS<br>ARGDYIRAAEKLRQEIYSSEERDERLTRMYNVRIMRVEFYFLSQYVSPADSP<br>FRHIFMGRGDHTLGALLDHLRLLRSNSSGTPGATSSTGFQESRFRRQLALLT<br>WTLQGAANALSGDVWNIDNNF<br>(SEQ ID NO: 204) |
| Human ADAM10 | >NM_001110.4 *Homo sapiens* ADAM metallopeptidase<br>domain 10 (ADAM10), transcript variant 1, mRNA<br>GTTGCCGGCCCCTGAAGTGGAGCGAGAGGGAGGTGCTTCGCCGTTTCTCCTG<br>CCAGGGGAGGTCCCGGCTTCCCGTGGAGGCTCCGGACCAAGCCCCTTCAGCT<br>TCTCCCTCCGGATCGATGTGCTGCTGTTAACCCGTGAGGAGGCGGCGGCGGC<br>GGCAGCGGCAGCGGAAGATGGTGTTGCTGAGAGTGTTAATTCTGCTCCTCTC<br>CTGGGCGGCGGGGATGGGAGGTCAGTATGGGAATCCTTTAAATAAATATATC<br>AGACATTATGAAGGATTATCTTACAATGTGGATTCATTACACCAAAAACACC<br>AGCGTGCCAAAAGAGCAGTCTCACATGAAGACCAATTTTTACGTCTAGATTT<br>CCATGCCCATGGAAGACATTTCAACCTACGAATGAAGAGGGACACTTCCCTT<br>TTCAGTGATGAATTTAAAGTAGAAACATCAAATAAAGTACTTGATTATGATA<br>CCTCTCATATTTACACTGGACATATTTATGGTGAAGAAGGAAGTTTTAGCCA<br>TGGGTCTGTTATTGATGGAAGATTTGAAGGATTCATCCAGACTCGTGGTGGC<br>ACATTTTATGTTGAGCCAGCAGCAGAGAGATATATTAAAGACCGAACTCTGCCAT<br>TTCACTCTGTCATTTATCATGAAGATGATATTAACTATCCCCATAAATACGG<br>TCCTCAGGGGGGCTGTGCAGATCATTCAGTATTTGAAAGAATGAGGAAATAC<br>CAGATGACTGGTGTAGAGGAAGTAACACAGATACCTCAAGAAGAACATGCTG<br>CTAATGGTCAGAACTTCTGAGGAAAAAACGTACAACTTCAGCTGAAAAAAA<br>TACTTGTCAGCTTTATATTCAGACTGATCATTTGTTCTTTAAATATTACGGA<br>ACACGAGAAGCTGTGATTGCCCAGATATCCAGTCATGTTAAAGCGATTGATA<br>CAATTTACCAGACCACAGACTTCTCCGGAATCCGTAACATCAGTTTCATGGT<br>GAAACGCATAAGAATCAATACAACTGCTGATGAGAAGGACCCTACAAATCCT<br>TTCCGTTTCCCAAATATTGGTGTGGAGAAGTTTCTGGAATTGAATTCTGAGC<br>AGAATCATGATGACTACTGTTTGGCCTATGTCTTCACAGACCGAGATTTTGA<br>TGATGGCGTACTTGGTCTGGCTTGGGTTGGAGCACCTTCAGGAAGCTCTGGA<br>GGAATATGTGAAAAAAGTAAACTCTATTCAGATGGTAAGAAGAAGTCCTTAA<br>ACACTGGAATTATTACTGTTCAGAACTATGGGTCTCATGTACCTCCCAAAGT<br>CTCTCACATTACTTTTGCTCACGAAGTTGGACATAACTTTGGATCCCCACAT<br>GATTCTGGAACAGAGTGCACACCAGGAGAATCTAAGAATTTGGGTCAAAAAG<br>AAAATGGCAATTACATCATGTATGCAAGAGCAACATCTGGGGACAAACTTAA<br>CAACAATAAATTCTCACTCTGTAGTATTAGAAATATAAGCCAAGTTCTTGAG<br>AAGAAGAGAAACAACTGTTTTGTTGAATCTGGCCAACCTATTTGTGGAAATG<br>GAATGGTAGAACAAGGTGAAGAATGTGATTGTGGCTATAGTGACCAGTGTAA<br>AGATGAATGCTGCTTCGATGCAAATCAACCAGAGGGAAGAAAATGCAAACTG<br>AAACCTGGGAAACAGTGCAGTCCAAGTCAAGGTCCTTGTTGTACAGCACAGT<br>GTGCATTCAAGTCAAAGTCTGAGAAGTGTCGGGATGATTCAGACTGTGCAAG<br>GGAAGGAATATGTAATGGCTTCACAGCTCTCTGCCCAGCATCTGACCCTAAA<br>CCAAACTTCACAGACTGTAATAGGCATACACAAGTGTGCATTAATGGGCAAT<br>GTGCAGGTTCTATCTGTGAGAAATATGGCTTAGAGGAGTGTACGTGTGCCAG<br>TTCTGATGGCAAAGATGATAAAGAATTATGCCATGTATGCTGTATGAAGAAA |

TABLE 3-continued

Exosome Targeting Domain

| Exosome Targeting Domain/Sticky Binder | Nucleic Acid Sequence (SEQ ID NO:) Amino Acid Sequence (SEQ ID NO:) |
|---|---|
| | ATGGACCCATCAACTTGTGCCAGTACAGGGTCTGTGCAGTGGAGTAGGCACT<br>TCAGTGGTCGAACCATCACCCTGCAACCTGGATCCCCTTGCAACGATTTTAG<br>AGGTTACTGTGATGTTTTCATGCGGTGCAGATTAGTAGATGCTGATGGTCCT<br>CTAGCTAGGCTTAAAAAAGCAATTTTTAGTCCAGAGCTCTATGAAAACATTG<br>CTGAATGGATTGTGGCTCATTGGTGGGCAGTATTACTTATGGGAATTGCTCT<br>GATCATGCTAATGGCTGGATTTATTAAGATATGCAGTGTTCATACTCCAAGT<br>AGTAATCCAAAGTTGCCTCCTCCTAAACCACTTCCAGGCACTTTAAAGAGGA<br>GGGAGACCTCCACAGCCCATTCAGCAACCCCAGCGTCAGCGGCCCCGAGAGAG<br>TTATCAAATGGGACACATGAGACGCTAACTGCAGCTTTTGCCTTGGTTCTTC<br>CTAGTGCCTACAATGGGAAAACTTCACTCCAAAGAGAAACCTATTAAGTCAT<br>CATCTCCAAACTAAACCCTCACAAGTAACAGTTGAAGAAAAAATGGCAAGAG<br>ATCATATCCTCAGACCAGGTGGAATTACTTAAATTTTAAAGCCTGAAAATTC<br>CAATTTGGGGGTGGGAGGTGGAAAAGGAACCCATTTTCTTATGAACAGATA<br>TTTTTAACTTAATGGCACAAAGTCTTAGAATATTATTATGTGCCCCGTGTTC<br>CCTGTTCTTCGTTGCTGCATTTTCTTCACTTGCAGGCAAACTTGGCTCTCAA<br>TAAACTTTTACCACAAATTGAAATAAATATATTTTTTTCAACTGCCAATCAA<br>GGCTAGGAGGCTCGACCACCTCAACATTGGAGACATCACTTGCCAATGTACA<br>TACCTTGTTATATGCAGACATGTATTTCTTACGTACACTGTACTTCTGTGTG<br>CAATTGTAAACAGAAATTGCAATATGGATGTTTCTTTGTATTATAAAATTTT<br>TCCGCTCTTAATTAAAAATTACTGTTTAATTGACATACTCAGGATAACAGAG<br>AATGGTGGTATTCAGTGGTCCAGGATTCTGTAATGCTTTACACAGGCAGTTT<br>TGAAATGAAAATCAATTTACCTTTCTGTTACGATGGAGTTGGTTTTGATACT<br>CATTTTTTCTTTATCACATGGCTGCTACGGGCACAAGTGACTATACTGAAGA<br>ACACAGTTAAGTGTTGTGCAAACTGGACATAGCAGCACATACTACTTCAGAG<br>TTCATGATGTAGATGTCTGGTTTCTGCTTACGTCTTTTAAACTTTCTAATTC<br>AATTCCATTTTTCAATTAATAGGTGAAATTTTATTCATGCTTTGATAGAAAT<br>TATGTCAATGAAATGATTCTTTTTATTTGTAGCCTACTTATTTGTGTTTTTC<br>ATATATCTGAAATATGCTAATTATGTTTTCTGTCTGATATGGAAAAGAAAAG<br>CTGTGTCTTTATCAAAATATTTAAACGGTTTTTTCAGCATATCATCACTGAT<br>CATTGGTAACCACTAAAGATGAGTAATTTGCTTAAGTAGTAGTTAAAATTGT<br>AGATAGGCCTTCTGACATTTTTTTTCCTAAAATTTTTAACAGCATTGAAGGT<br>GAAACAGCACAATGTCCCATTCCAAATTTATTTTTGAAACAGATGTAAATAA<br>TTGGCATTTTAAAGAGAAAGCAAAAACATTTAATGTATTAACAGGCTTATTG<br>CTATGCAGGAAATAGAAGGGGCATTACAAAAATTGAAGCTTGTGACATATTT<br>ATTGCTTCTGTTTTCCAACTACATCACTTCAACTAGAAGTAAAGCTATGATT<br>TTCCTGACTTCACATAGGAGGCAAATTTAGAGAAAGTTGTAAAGATTTCTAT<br>GTTTTGGGTTTTTTTTTTCCTTTTTTTTTTAAGAGTATAAGGTTTACACA<br>ATCATTCTCATAATGTGACGCAAGCCAGCAAGGCCAAAAATGCTAGAGAAAA<br>TAACGGGATCTCTTCCTTGTAAACTTGTACAGTATGTGGTGACTTTTTCAAA<br>ATACAGCTTTTTGTACATGATTTAGAGACAAATTTTGTACATGAAACCCCAG<br>ATAGACTATAAATAATTCTAAACAAACAAGTAGGTAGATATGTATGTAATTG<br>CTTTTAAATCATTTAAATGCCTTTGTTTTTGGACTGTGCAAAGGTTGGAAGT<br>GGGTTTGCATTTCTAAAATGGTGACTTTTATTCTGCAAGAGTTCTTAGTAAC<br>TTCTTGAGTGTGGTAGACTTTGGAACATGTAAATTTTTTGCTTGTAATGTTA<br>TCCTGTGGTAGGATTTTGGCAGGTACACACACTGCCCTATTTTATTTTGAGT<br>CTAAGTTAAATGTTTTCTGAAAAGAGATACATGCACTGAACTCTTTCCACTG<br>CGAATCAAGATGTGGTAATATAAAAGGATCAAGACAAATGAGATCTAATACT<br>ACTGTCAGTTTTAATGTCCACTGTGTTTTATACAGTATCTTTTTTTGTTCAC<br>TTTGGAAATTTTTACTAAAAATTGCAAAAAATAAAGTATTGTGCAAAGATGT<br>AAGGTTTTTTGAAACTTGAAATGCATTAATAAATAGACGATTAAATCAACTT<br>GAAGGTTCTATACTCTTTGAACTCTGAGAACTATCACAAGAAGCTTCCCACA<br>AGGCAGTGTTTTCTTACAGTTGTCTCTTCCTACAAAAGTATAGATTATCTTT<br>ATTCTTAATACTTTGGAATCCATGTAGAAAATTTCCAGTTAGATACTCTGCG<br>TACACACAATAAACCTTTTTAAAACACCCAACTAATCTCAACTGCATTACAT<br>TGTTTCTAATCAATATTCAGTGCTTGTCTTGGTGGAAGAGGTGAGTCATTTT<br>GAAAACTTATGGTCTTGTTTTTATGTGTTTTTCAAAGTTTTGAATGCTAAGT<br>ACCTCATTTATTTTAAAAAGCCTAGTTTAATGATAAGTTTGTTTAAAATTTT<br>GAGCCATCATTTTTCTCTTCATAGCAAATAAGGAGAGAATTGACATTTCAGT<br>GTTACCTAGAAAAGGAATTGTAAGCCCAGAATAATTCCCTGCATGAGGTAAT<br>CTGCTTCAAATTCTTTTTTAGTCAAGGTTAGCTATAAGTAATACTTGTTAA<br>ATGAGTAAATATGTAATACTTTGTGAATTACTTTGTTAATTTAGGAGCATCA<br>AATGTATATTATGTTTAGTTATTTATGAAACTCTCAATATTGATTGATTTGG<br>GTAATTATAAATTAGTTATTTTACTTGTAATTGAATGCTTAAATTCTGTTT<br>ACAGTCCGTCCTCTCTCCCTCCATCCCTCCCTCCCCAGTTTTATAAATTCAG<br>GTACCAATTCACAAACAAAATCAGAAATAAAATAAATTTATTGACTGCTTCT<br>GGATTTAGCATTCCCTGTAGTGTCAAGCAATGTCATGCAGTTTGGGGAAGCA<br>TTTATTTAAGGAAATGACAACTTTCTCTGATCAGTCTTGTTTTGTGAGGTGT<br>CTTCAACACTTTATGCTTTGGGTACTTCGTGTTTGTCACAGTCTTAGGATAG<br>TGAAATCTGATTTGTCCAAGCGGAGCAAACTACTCGACCCTCAGTCCTTGTA<br>TTTGTCCCTGTAGTAAGACCTAATTATTATTATTTCTTAAAGATGGGATTGG<br>TGTCCTTGGCAACTATGAAATTCGGGGCTTGTGCATGAGAAGGCATTTCTT<br>ATTAAGTATTTCTAATTGAAGGTATCAGAGTGTCAAGCATTACAAACCTGGA<br>CAGTTCACCTGGAGGAGTACAAGAAGAGATATTCATTATCCATATTTAAGG<br>GTCAAGGTTTCCCAAAACCAGGGTGCAAGCCAGATGTAGTTTTAAAGCAGCT |

TABLE 3-continued

Exosome Targeting Domain

| Exosome Targeting Domain/Sticky Binder | Nucleic Acid Sequence (SEQ ID NO:) Amino Acid Sequence (SEQ ID NO:) |
|---|---|
| | GCCAGGGACAGTTCATCTTTAGAGAAGTCACTAAAGTTGTAAGAAATTTTAG
TTTCCCCAAAACCACTTTCAACTTCTTAGAAACTAGAAAGACAATTGGTTTG
CCCCACAGAGGACAACTTCAGTTTCAGCATCTCTCATGTTGTGTTCTTGATT
AAAAACAACTTCCATTTGATATACTTTTCCGTTTATTACCAGTTTAGTTTTT
TCACTATTGTTTCTGTATTCAACTCTTTATATGATTAGGATAGAAATTTAGC
CCTTCTGTTTTATATTACTATATTGTTTGTGTGTCTTAGATATATACATGTA
TGTACTATTTTCAGTAGAAATTCATGTATTTTATAATTGGTAAGTTCTTCAG
AGCATCTCTTCTATAAAAAGCAACAGGATGCTAGGTAAAACGGAGCATTGAG
CAAAATACTGATTAGTTTTTGCTTTTTCCTGAAATCTACACTAAAGTGATAG
GGTGTGGGGTAATCCAACAAGGACAAGGTGAATTGAACAAGAACGAAATCTG
GAAGCAGATGAAGGAGTACTATTGATTGGGCAGACCCAGGGAAGTCAAATCC
TAAACCAGCAGTGGGAACACAACAGAATGGTGTAGTTTGCACTGGTAAGATT
TGGGTACCTGGCAGGGCTGGGTGCGGTGGCTCACACCTGTAATCCCAGCACT
TTGGGAGGCCAAGGCGGGTGGATCACTTGAGGTCAGGAGTTCGAGACCACCC
TGGCCAACATGGTGAAACCCCGTCTCTACTAAAAATACAGCTGGGCGTGGTG
GCACATGCTTGTAATCCCAGCTACTCGGGAGGCAGAGGCAGGAGATTTGCTT
GAACCCGGGAGGCAGAGGCAGGAGATTTGCTTGAACCCAGGAGGCAGAGGCT
GCAGTGAGCCGCGATTGCGCCATTGCACTCCAGCCTGGGTGACAGAGCGAGA
CTCTGTCTCAAAAAAAAAAAAAAAAAAAAAAAAAAAAAAAAAAAAAAAAAA
AAAAATTTGAGTACCTGGCCTTTGTTACTTTTTTTCTATGTGTGTGACAAAA
ACATAATATGCACACTTTTGTAACCCACCTTTCTCATTTAATGGTACATTGA
TAATGTATATCACATTAACTACTCTAAATATTTCTGTGGATGTATGTTTTTT
TTTTTCTTAACCAATTTCCCATTGTTTGGACATGTAGGTTCCACATTGTTTA
TTATTTTAAACAATTCTAAAGAATTTTAAACAATTCTTAGGAAAATCCTCAG
CCTAATAATGAAATTAATTCCTAAAAGTGGAATTGTTGGGGTAAAGGTTTTT
TGAGGGACATTGATAAAAATTATGGTACTGTCTCCCAGATAGATGTACCAAG
TTATACTACCACGATTTAATATATATATATATATATATTAAATCAGAGTCCC
ATCCTTAGAAATCCACATATATGCAGCCACATGAATGTATTAGAAACAATAA
TAGAAGACTCATGCTTAATTCAGTTGATTAGCTTTAGACATAATTCAAATGC
AAGTCAAATTGAGTGCCCTAATTGTGGTCTCTTAAGTACCATTTTTCTTCAA
GGGAACCAGACTCCTTTGGATAAATCACTAATTCCACCTGTAAGAAAGAAAT
GTACAAGAAGAACCTAGGAAACATTGTTTTGTACCAGATCAGAAAGATTCAG
GAGGCACCTTAGAAGTTACCACTGGCCAAGGCTGAGATAACTTTAGCATCAG
CAAGGATAATATCTGCAAGAGATTGAAACTCATAGTATTGTATTTAACTCTG
TGAGTTAATGATGGTAGTGGACAGAATTATAGTTACCTTTGGGATACGCTTT
TAAAGAAATTCCAGGTAATAAGAGAAATGATAGAATTAGGATATCACCATTT
TACCCCCCCAACAATTTATGGATCTAGACAATAATCGCCAGTGACTGCTAAC
CTCACAAAGTGAGAGCAATCAGATTTTGTGCCTCCTAATGGAAGTACATATA
CCACCTATGAAGCAGTTCTGCCAAAAGTCACATCTCATCATGATGAAGCCTC
CTGATCTAACTACCCCTTCATTAGAAATACAGGGGACAGAGGGACAAATAAT
ATACAAGGGACTCAATCAGCAAAATCCAGACTCTGGAAAACTACAAGACATA
TGGTCCTGCTTCAACAACAGAAATGCAAAGAGAAAAGACAACGATGGGTTAA
AGGAGACTTAAGAGCTACATCTATCAAGACAATTTATGGACTTATTTGGATA
CTGATTTGAACAAACTGTTGAGACCATTGGAAAAATGTGAAAAGTGGATATT
TGATATTAAGGTTTTTAATTATTTTTAGGTGTGATAATGGTATTGTTACATT
TTTTAAAGGACCCCTTTTAGAGATGCAAATTGAAACACTTAAAAAATGAAAT
GATACGATGTATAAGTTTTTGCTTAAAAATAAGGATTGAAGTTGGCTGGTGT
GTGTGGATATAGTTGAAACAAGATTGGCTGTGAGTTGATAATTATTGAAGCT
GGGTGATGGGCACTTGGGGATTTATTATACTATTTTCTCTACCTGTGTTTAT
ATTTGAAATTTTTCATAGAAGTTTTAAAATGTGGCCAGTTGTGATGGCTCAT
ACCTGTAATCCCAACACTTTGGGAGGCCAAGGTGGGAGGATCACTTGAGCTC
AGGAGTTAGAGACCAGCCTGGGCAAAATAGTGAGACTCCATCTCAAAGAAAA
AAAAAAGTGTTTTAAATGTGAATCAAATTCCTATAGAAGCTGATTCATTAC
TGTTTTTATTTTAGCAGTAATTCATGATAATGACCTGTATTCATAATGATTT
TCATAATGATTGTTTTAGTGGAATTAAACTTGAACCAGTCAAGCTAACATAA
TTATATTCTGCTCCAGTTACAATGAATAATTAATTGATTTCAACTGCTAGGG
TGAACTCTTGAAGCTATCAGTCATCCAGCAATCTTAGCAAGCAGGCCATTGG
GTCCCTGTTTGCTCTGTCTCTCTCTCTCTCTCACTGTTGAAGGGCTTAGC
TAACTACTTAAGTAAAATATTTGTTCTCTGTTAAACATGTCAAGGAGTATGG
TCAGCTTATCCACATTAAGCCTGTGTGTCCCACGTTGGAGTAAATGTTAAGT
AGCTCACTACAATAAACTAGATTCTTCTGCCCTCTCTTGTTTAAATGATCAT
GTTCCCTGGAGGTGGAAATAGATCTTTAAAAAGATATTCTGTAGTTGTTTGT
TCTCAGTGTAAAAAAATGAGAATAATTTGATAAGAGTGTAGGTTGTCTTATA
TAAAAAGTGGTTCCATTTGCATGAATTTTAGAAAAATCATTTTGGAAAAATG
AAGGCTATGTGGTTATACTGAACACATTAAGCAATTTTATTCTTTATTTTAA
ATGAATATTTTATTATCGTTTTCTTCCCTTGCCCTTTGGGTATGGGAGTTAG
CCTTTGTGTTTCTAAATACAACAGGCCGGTTTTATAAATTAAGGTGTCAAT
ATATTCTTCATTATTTAGTTTTGTGATTGTGGTTAGTTTTCATTTTTCTTAA
GTATCTGCTAGTAGCATCTGTAATTAAGTGAAGTGACCTGTTAACCATTTTC
CTCTTTCTCCTCCTTTCCTCCTCCTTGAAACATATCAGAGCATGTTTGAAAT
TCTTTGGCTTTTATGGTATGCATTTGCTGATATGCATTGACCAGTTACCTTA
CTCACAGATACTTCTTAGGCACTTGATTGTGCCAGGGCCTTGGCTAGATGAT
AAGAATACAGTAGTGAACTTAACAGTTTCCCTGCCCTGGTGAAGCGTATGGT
CTTGTAGGTGAGATAGATATCAGATAATCATGTGAATAAATGTACAATTCCA |

TABLE 3-continued

Exosome Targeting Domain

| Exosome Targeting Domain/Sticky Binder | Nucleic Acid Sequence (SEQ ID NO:) Amino Acid Sequence (SEQ ID NO:) |
|---|---|
| | GCTGTGATACATGCTGAGGAGGAGGTTTTGGTGATCCAAGAGCTGATCATG<br>CAGAGATAGGACTGAGAAAGGAGGGTGGGACGTTGTCACAGCTGATAATGCA<br>GAGATAGGACTGAGAAAGGAGGGTGGGACATCAGGAAGGTCAGAGAATTCCT<br>TATGAAAGTGATGCTTGAGTCAAAATATGATGGATGAAGAGAGTTTAAATAG<br>ATTACATAGAATTTTTAATAATGTCGATTGGTTATATACTGGGCACTGATAG<br>CTGATTTTTCTTTGGGGAAAGGTATGTCAGCCTAGTCATTCAGATTCCTTTA<br>TTTTTTTAAATGTTTTTTCATTTTTTGCTTTGCATTGCATTCATTTGCTGAA<br>GAGCTGGCTTGTACTTTGGCAGGTGTCATACTTGGTTATTCTCCTTAGGATA<br>TTGGCCCAACAATCTGGGAGTTGTGAAAGGCGCTTCGCTTTTCAGACCTGGG<br>CGTCTGTATCATGACTATCATAAATTTAGGATTAAGACACCTAGCCTCCTAC<br>CAGGATGAATGAGGTGTCCATGTGACCTGCTGTGCCCTGGAATTTTATACAT<br>CTTTCTCTCATAGCACACACCATATTACAATATAATCCTGCCTCATCTAAGC<br>CAAACTTTCGAGAGAATCATTTACACTCAGTGGCTACTTCAGCTCCCATTCA<br>CTTATCAACCTGCTGCAATTTTTCACAGCCCCCAAAGGACTGCAGTCTGTGC<br>CTTCAGGGAGCTGAGGGTCTAGCGGAAGGAAAGAAACCAGCAGTTACAGTAC<br>AGAGGGGTTTGTGTTGGAAACTCTACAAACACAGGATGCCCTGGTAGCTCAG<br>AGGAAGTGCATATCGAGCATGGTAGGTAGGTAGTGGGAAGAGCCAAGATGAC<br>TTCCCAGAGGAGAAAAGCTGGACCTGAGTTTTGGAGTTTCGGTAAAAGTTTG<br>CTCTAACTAGTCCAAGCTGCTGTCACAAGCTTTTAGAAATGATGTAACCATG<br>GGGCAGTTGACTGTCGTCATGTTCTTTGCTATTTTCATGACTCTGGATGTGC<br>TTTTCCTATTCCCTGGATTGCCCTTTCCCTCGATTCCTCTGCAGGACTGGGC<br>TTTATTAATCTCCATTTCCTTGAGCTTGGCTATAGTAGGTGTTCAATAAACA<br>TTTGTTTTGTTGTGTGCTTTGTAAATAGGCAATGAAGCTGATTTCACAAGAT<br>AGGCACAAAAGTTAGTTTCATTACAACACATTACCAACAGCTGTATTTTTAA<br>CTTTTAACATATCTCATTCTAAATCCTGTGGCAGCACAACCTCCTTCCGTCA<br>TACCTGGAGATAAATTTTCTTTCAAAATCTAATATGCACTGTATTTATAGAA<br>TATGAAACATACCGACCATGTTTTGCAAAAATGGGAAAGGCATAACTTAGCT<br>TTGGGGCATGTAAGTAACAACTCCTGATAGGAGAAGAAATGTATTCAGAAAG<br>CTCAAATTAGAAATAAAATGGGAGACTCTA (SEQ ID NO: 205)<br>>NP_001101.1 disintegrin and metalloproteinase<br>domain-containing protein 10 isoform 1 preproprotein<br>[Homo sapiens]<br>MVLLRVLILLLSWAAGMGGQYGNPLNKYIRHYEGLSYNVDSLHQKHQRAKRA<br>VSHEDQFLRLDFHAHGRHFNLRMKRDTSLFSDEFKVETSNKVLDYDTSHIYT<br>GHIYGEEGSFSHGSVIDGRFEGFIQTRGGTFYVEPAERYIKDRTLPFHSVIY<br>HEDDINYPHKYGPQGGCADHSVFERMRKYQMTGVEEVTQIPQEEHAANGPEL<br>LRKKRTTSAEKNTCQLYIQTDHLFFKYYGTREAVIAQISSHVKAIDTIYQTT<br>DFSGIRNISFMVKRIRINTTADEKDPTNPFRFPNIGVEKFLELNSEQNHDDY<br>CLAYVFTDRDFDDGVLGLAWVGAPSGSSGGICEKSKLYSDGKKKSLNTGIIT<br>VQNYGSHVPPKVSHITFAHEVGHNFGSPHDSGTECTPGESKNLGQKENGNYI<br>MYARATSGDKLNNNKFSLCSIRNISQVLEKKRNNCFVESGQPICGNGMVEQG<br>EECDCGYSDQCKDECCFDANQPEGRKCKLKPGKQCSPSQGPCCTAQCAFKSK<br>SEKCRDDSDCAREGICNGFTALCPASDPKPNFTDCNRHTQVCINGQCAGSIC<br>EKYGLEECTCASSDGKDDKELCHVCCMKKMDPSTCASTGSVQWSRHFSGRTI<br>TLQPGSPCNDFRGYCDVFMRCRLVDADGPLARLKKAIFSPELYENIAEWIVA<br>HWWAVLLMGIALIMLMAGFIKICSVHTPSSNPKLPPPKPLPGTLKRRRPPQP<br>IQQPQRQRPRESYQMGHMRR (SEQ ID NO: 206) |
| Transmembrane domain 2 or transmembrane domain 3 from Human CD9 | >NM_001769.4 Homo sapiens CD9 molecule (CD9),<br>transcript variant 1, mRNA<br>AGCCGCCTGCATCTGTATCCAGCGCCAGGTCCCGCCAGTCCCAGCTGCGCGC<br>GCCCCCCAGTCCCGCACCCGTTCGGCCCAGGCTAAGTTAGCCCTCACCATGC<br>CGGTCAAAGGAGGCACCAAGTGCATCAAATACCTGCTGTTCGGATTTAACTT<br>CATCTTCTGGCTTGCCGGGATTGCTGTCCTTGCCATTGGACTATGGCTCCGA<br>TTCGACTCTCAGACCAAGAGCATCTTCGAGCAAGAAACTAATAATAATAATT<br>CCAGCTTCTACACAGGAGTCTATATTCTGATCGGAGCCGGCGCCCTCATGAT<br>GCTGGTGGGCTTCCTGGGCTGCTGCGGGGCTGTGCAGGAGTCCCAGTGCATG<br>CTGGGACTGTTCTTCGGCTTCCTCTTGGTGATATTCGCCATTGAAATAGCTG<br>CGGCCATCTGGGGATATTCCCACAAGGATGAGGTGATTAAGGAAGTCCAGGA<br>GTTTTACAAGGACACCTACAACAAGCTGAAAACCAAGGATGAGCCCCAGCGG<br>GAAACGCTGAAAGCCATCCACTATGCGTTGAACTGCTGTGGTTTGGCTGGGG<br>GCGTGGAACAGTTTATCTCAGACATCTGCCCCAAGAAGGACGTACTCGAAAC<br>CTTCACCGTGAAGTCCTGTCCTGATGCCATCAAAGAGGTCTTCGACAATAAA<br>TTCCACATCATCGGCGCAGTGGGCATCGGCATTGCCGTGGTCATGATATTTG<br>GCATGATCTTCAGTATGATCTTGTGCTGTGCTATCCGCAGGAACCGCGAGAT<br>GGTCTAGAGTCAGCTTACATCCCTGAGCAGGAAAGTTTACCCATGAAGATTG<br>GTGGGATTTTTTGTTTGTTTTGTTTTGTTTGTTGTTTGTTGTTTGTTT<br>TTTTGCCACTAATTTTAGTATTCATTCTGCATTGCTAGATAAAAGCTGAAGT<br>TACTTTATGTTTGTCTTTTAATGCTTCATTCAATATTGACATTTGTAGTTGA<br>GCGGGGGTTTGGTTTGCTTTGGTTTATATTTTTTCAGTTGTTTGTTTTTGC<br>TTGTTATATTAAGCAGAAATCCTGCAATGAAAGGTACTATATTTGCTAGACT<br>CTAGACAAGATATTGTACATAAAAGAATTTTTTTGTCTTTAAATAGATACAA<br>ATGTCTATCAACTTTAATCAAGTTGTAACTTATATTGAAGACAATTTGATAC<br>ATAATAAAAAATTATGACAATGTCCTGGA (SEQ ID NO: 207) |

TABLE 3-continued

Exosome Targeting Domain

| Exosome Targeting Domain/Sticky Binder | Nucleic Acid Sequence (SEQ ID NO:) Amino Acid Sequence (SEQ ID NO:) |
|---|---|
| | >NP_001760.1 CD9 antigen isoform 1 [Homo sapiens]<br>MPVKGGTKCIKYLLFGFNFIFWLAGIAVLAIGLWLRFDSQTKSIFEQETNNN<br>NSSFYTGVYILIGAGALMMLVGFLGCCGAVQESQCMLGLFFGFLLVIFAIEI<br>AAAIWGYSHKDEVIKEVQEFYKDTYNKLKTKDEPQRETLKAIHYALNCCGLA<br>GGVEQFISDICPKKDVLETFTVKSCPDAIKEVFDNKFHIIGAVGIGIAVVMI<br>FGMIFSMILCCAIRRNREMV (SEQ ID NO: 208) |
| Human CD298 | >NM_001679.4 Homo sapiens ATPase Na+/K+ transporting subunit beta 3 (ATP1B3), mRNA<br>AGTCGGCTCGAGTACTCCCCGTAACGAGGAGGTGTTCTCGGCCGTCCCACCC<br>TTCACTGCCGTCTCCGGGCTGCGCCGCCGGAGCCGGGACGCGCCTCCGCAGC<br>CCTCGCCGCCTCCATCCCCGCGGCCGCAGCTCCTCTCGCCGTCCGCGCGCAC<br>ACCATGACGAAGAACGAGAAGAAGTCCCTCAACCAGAGCCTGGCCGAGTGGA<br>AGCTCTTCATCTACAACCCGACCACCGGAGAATTCCTGGGGCGCACCGCCAA<br>GAGCTGGGGTTTGATCTTGCTCTTCTACCTAGTTTTTTATGGGTTCCTGGCT<br>GCACTCTTCTCATTCACGATGTGGGTTATGCTTCAGACTCTCAACGATGAGG<br>TTCCAAAATACCGTGACCAGATTCCTAGCCCAGGACTCATGGTTTTTCCAAA<br>ACCAGTGACCGCATTGGAATATACATTCAGTAGGTCTGATCCAACTTCGTAT<br>GCAGGGTACATTGAAGACCTTAAGAAGTTTCTAAAACCATATACTTTAGAAG<br>AACAGAAGAACCTCACAGTCTGTCCTGATGGAGCACTTTTTGAACAGAAGGG<br>TCCAGTTTATGTTGCATGTCAGTTTCCTATTTCATTACTTCAAGCATGCAGT<br>GGTATGAATGATCCTGATTTTGGCTATTCTCAAGGAAACCCTTGTATTCTTG<br>TGAAAATGAACAGAATAATTGGATTAAAGCCTGAAGGAGTGCCAAGGATAGA<br>TTGTGTTTCAAAGAATGAAGATATACCAAATGTAGCAGTTTATCCTCATAAT<br>GGAATGATAGACTTAAAATATTTCCCATATTATGGGAAAAAACTGCATGTTG<br>GGTATCTACAGCCATTGGTTGCTGTTCAGGTCAGCTTTGCTCCTAACAACAC<br>TGGGAAAGAAGTAACAGTTGAGTGCAAGATTGATGGATCAGCCAACCTAAAA<br>AGTCAGGATGATCGTGACAAGTTTTTGGGACGAGTTATGTTCAAAATCACAG<br>CACGTGCATAGTATGAGTAGGATATCTCCACAGAGTAAATGTTGTGTTGTCT<br>GTCTTCATTTTGTAACAGCTGGACCTTCCATTCTAGAATTATGAGACCACCT<br>TGGAGAAAGGTGTGTGGTACATGACATTGGGTTACATCATAACGTGCTTCCA<br>GATCATAGTGTTCAGTGTCCTCTGAAGTAACTGCCTGTTGCCTCTGCTGCCC<br>TTTGAACCAGTGTACAGTCGCCAGATAGGGACCGGTGAACACCTGATTCCAA<br>ACATGTAGGATGGGGGTCTTGTCCTCTTTTTATGTGGTTTAATTGCCAAGTG<br>TCTAAAGCTTAATATGCCGTGCTATGTAAATATTTTATGGATATAACAACTG<br>TCATATTTTGATGTCAACAGAGTTTTAGGGATAAAATGGTACCCGGCCAACA<br>TCAAGTGACTTTATAGCTGCAAGAAATGTGGTATGTGGAGAAGTTCTGTATG<br>TGAGGAAGGAAAAAAAGAAAATAAAAGTGTGTTTGAAAAATATTATCTTGGG<br>TTCTTTGTAAAATTTATTTTTTACATGCTGAATTAGCCTCGATCTTTTTGAT<br>TAAGAGCACAAACTTTTTTTTGTAAAACATGTAAAAAAAAAAACTGGGATTA<br>ATTTTTAGTGTTGGAACTGCCTCTTATTTTAGGCTGTAGATAAAATAGCATT<br>TTTAGGTTAGCCAGTGTGACTATGCACCTAATTTTTTATGAGATTAAATTCA<br>TAAGACTTAATTTGTACAATAGTTTGTGAAATATCTTGTTACTGCTTTTATT<br>TAGCAGACTGTGGACTGTAATAAAGTATATAAATTGTGAAATATAAAAACTT<br>GGAACTTATTCAAAGCTTCAAAGCAAA (SEQ ID NO: 209)<br>>NP_001670.1 sodium/potassium-transporting ATPase subunit beta-3 [Homo sapiens]<br>MTKNEKKSLNQSLAEWKLFIYNPTTGEFLGRTAKSWGLILLFYLVFYGFLAA<br>LFSFTMWVMLQTLNDEVPKYRDQIPSPGLMVFPKPVTALEYTFSRSDPTSYA<br>GYIEDLKKFLKPYTLEEQKNLTVCPDGALFEQKGPVYVACQFPISLLQACSG<br>MNDPDFGYSQGNPCILVKMNRIIGLKPEGVPRIDCVSKNEDIPNVAVYPHNG<br>MIDLKYFPYYGKKLHVGYLQPLVAVQVSFAPNNTGKEVTVECKIDGSANLKS<br>QDDRDKFLGRVMFKITARA (SEQ ID NO: 210) |
| Lipid affinity tag modified from Human KRAS | >NM_004985.5 Homo sapiens KRAS proto-oncogene, GTPase (KRAS), transcript variant b, mRNA<br>CTAGGCGGCGGCCGCGGCGGCGGAGGCAGCAGCGGCGGCGGCAGTGGCGGCG<br>GCGAAGGTGGCGGCGGCTCGGCCAGTACTCCCGGCCCCCGCCATTTCGGACT<br>GGGAGCGAGCGCGGCGCAGGCACTGAAGGCGGCGGCGGGGCCAGAGGCTCAG<br>CGGCTCCCAGGTGCGGGAGAGAGGCCTGCTGAAAATGACTGAATATAAACTT<br>GTGGTAGTTGGAGCTGGTGGCGTAGGCAAGAGTGCCTTGACGATACAGCTAA<br>TTCAGAATCATTTTGTGGACGAATATGATCCAACAATAGAGGATTCCTACAG<br>GAAGCAAGTAGTAATTGATGGAGAAACCTGTCTCTTGGATATTCTCGACACA<br>GCAGGTCAAGAGGAGTACAGTGCAATGAGGGACCAGTACATGAGGACTGGGG<br>AGGGCTTTCTTTGTGTATTTGCCATAAATAATACTAAATCATTTGAAGATAT<br>TCACCATTATAGAGAACAAATTAAAAGAGTTAAGGACTCTGAAGATGTACCT<br>ATGGTCCTAGTAGGAAATAAATGTGATTTGCCTTCTAGAACAGTAGACACAA<br>AACAGGCTCAGGACTTAGCAAGAAGTTATGGAATTCCTTTTATTGAAACATC<br>AGCAAAGACAAGACAGGGTGTTGATGATGCCTTCTATACATTAGTTCGAGAA<br>ATTCGAAACATAAAGAAAAGATGAGCAAAGATGGTAAAAAGAAGAAAAAGA<br>AGTCAAAGACAAAGTGTGTAATTATGTAAATACAATTTGTACTTTTTTCTTA<br>AGGCATACTAGTACAAGTGGTAATTTTTGTACATTACACTAAATTATTAGCA<br>TTTGTTTTAGCATTACCTAATTTTTTTCCTGCTCCATGCAGACTGTTAGCTT<br>TTACCTTAAATGCTTATTTTAAAATGACAGTGGAAGTTTTTTTTTCCTCTAA |

TABLE 3-continued

Exosome Targeting Domain

| Exosome Targeting Domain/Sticky Binder | Nucleic Acid Sequence (SEQ ID NO:) Amino Acid Sequence (SEQ ID NO:) |
|---|---|
| | GTGCCAGTATTCCCAGAGTTTTGGTTTTTGAACTAGCAATGCCTGTGAAAAA<br>GAAACTGAATACCTAAGATTTCTGTCTTGGGGCTTTTGGTGCATGCAGTTGA<br>TTACTTCTTATTTTTCTTACCAATTGTGAATGTTGGTGTGAAACAAATTAAT<br>GAAGCTTTTGAATCATCCCTATTCTGTGTTTTATCTAGTCACATAAATGGAT<br>TAATTACTAATTTCAGTTGAGACCTTCTAATTGGTTTTTACTGAAACATTGA<br>GGGAACACAAATTTATGGGCTTCCTGATGATGATTCTTCTAGGCATCATGTC<br>CTATAGTTTGTCATCCCTGATGAATGTAAAGTTACACTGTTCACAAAGGTTT<br>TGTCTCCTTTCCACTGCTATTAGTCATGGTCACTCTCCCCAAAATATTATAT<br>TTTTTCTATAAAAAGAAAAAAATGGAAAAAAATTACAAGGCAATGGAAACTA<br>TTATAAGGCCATTTCCTTTTCACATTAGATAAATTACTATAAAGACTCCTAA<br>TAGCTTTTCCTGTTAAGGCAGACCCAGTATGAAATGGGGATTATTATAGCAA<br>CCATTTTGGGGCTATATTTACATGCTACTAAATTTTTATAATAATTGAAAAG<br>ATTTTAACAAGTATAAAAAATTCTCATAGGAATTAAATGTAGTCTCCCTGTG<br>TCAGACTGCTCTTTCATAGTATAACTTTAAATCTTTTCTTCAACTTGAGTCT<br>TTGAAGATAGTTTTAATTCTGCTTGTGACATTAAAAGATTATTTGGGCCAGT<br>TATAGCTTATTAGGTGTTGAAGAGACCAAGGTTGCAAGGCCAGGCCCTGTGT<br>GAACCTTTGAGCTTTCATAGAGAGTTTCACAGCATGGACTGTGTCCCCACGG<br>TCATCCAGTGTTGTCATGCATTGGTTAGTCAAAATGGGGAGGGACTAGGGCA<br>GTTTGGATAGCTCAACAAGATACAATCTCACTCTGTGGTGGTCCTGCTGACA<br>AATCAAGAGCATTGCTTTTGTTTCTTAAGAAAACAAACTCTTTTTTAAAAAT<br>TACTTTTAAATATTAACTCAAAAGTTGAGATTTTGGGGTGGTGGTGTGCCAA<br>GACATTAATTTTTTTTTAAACAATGAAGTGAAAAAGTTTTACAATCTCTAG<br>GTTTGGCTAGTTCTCTTAACACTGGTTAAATTAACATTGCATAAACACTTTT<br>CAAGTCTGATCCATATTTAATAATGCTTTAAAATAAAAATAAAAACAATCCT<br>TTTGATAAATTTAAAATGTTACTTATTTTAAAATAAATGAAGTGAGATGGCA<br>TGGTGAGGTGAAAGTATCACTGGACTAGGAAGAAGGTGACTTAGGTTCTAGA<br>TAGGTGTCTTTAGGACTCTGATTTTGAGGACATCACTTACTATCCATTTCT<br>TCATGTTAAAAGAAGTCATCTCAAACTCTTAGTTTTTTTTTTTACAACTAT<br>GTAATTTATATTCCATTTACATAAGGATACACTTATTTGTCAAGCTCAGCAC<br>AATCTGTAAATTTTTAACCTATGTTACACCATCTTCAGTGCCAGTCTTGGGC<br>AAAATTGTGCAAGAGGTGAAGTTTATATTTGAATATCCATTCTCGTTTTAGG<br>ACTCTTCTTCCATATTAGTGTCATCTTGCCTCCCTACCTTCCACATGCCCCA<br>TGACTTGATGCAGTTTTAATACTTGTAATTCCCCTAACCATAAGATTTACTG<br>CTGCTGTGGATATCTCCATGAAGTTTTCCCACTGAGTCACATCAGAAATGCC<br>CTACATCTTATTTCCTCAGGGCTCAAGAGAATCTGACAGATACCATAAAGGG<br>ATTTGACCTAATCACTAATTTTCAGGTGGTGGCTGATGCTTTGAACATCTCT<br>TTGCTGCCCAATCCATTAGCGACAGTAGGATTTTTCAAACCTGGTATGAATA<br>GACAGAACCCTATCCAGTGGAAGGAGAATTTAATAAAGATAGTGCTGAAAGA<br>ATTCCTTAGGTAATCTATAACTAGGACTACTCCTGGTAACAGTAATACATTC<br>CATTGTTTTAGTAACCAGAAATCTTCATGCAATGAAAAATACTTTAATTCAT<br>GAAGCTTACTTTTTTTTTTGGTGTCAGAGTCTCGCTCTTGTCACCCAGGCT<br>GGAATGCAGTGGCGCCATCTCAGCTCACTGCAACCTCCATCTCCCAGGTTCA<br>AGCGATTCTCGTGCCTCGGCCTCCTGAGTAGCTGGGATTACAGGCGTGTGCC<br>ACTACACTCAACTAATTTTTGTATTTTTAGGAGAGACGGGGTTTCACCCTGT<br>TGGCCAGGCTGGTCTCGAACTCCTGACCTCAAGTGATTCACCCACCTTGGCC<br>TCATAAACCTGTTTTGCAGAACTCATTTATTCAGCAAATATTTATTGAGTGC<br>CTACCAGATGCCAGTCACCACACAAGGCACTGGGTATATGGTATCCCCAAAC<br>AAGAGACATAATCCCGGTCCTTAGGTAGTGCTAGTGTGGTCTGTAATATCTT<br>ACTAAGGCCTTTGGTATACGACCCAGAGATAACACGATGCGTATTTTAGTTT<br>TGCAAAGAAGGGGTTTGGTCTCTGTGCCAGCTCTATAATTGTTTTGCTACGA<br>TTCCACTGAAACTCTTCGATCAAGCTACTTTATGTAAATCACTTCATTGTTT<br>TAAAGGAATAAACTTGATTATATTGTTTTTTTATTTGGCATAACTGTGATTC<br>TTTTAGGACAATTACTGTACACATTAAGGTGTATGTCAGATATTCATATTGA<br>CCCAAATGTGTAATATTCCAGTTTTCTCTGCATAAGTAATTAAAATATACTT<br>AAAAATTAATAGTTTTATCTGGGTACAAATAAACAGGTGCCTGAACTAGTTC<br>ACAGACAAGGAAACTTCTATGTAAAAATCACTATGATTTCTGAATTGCTATG<br>TGAAACTACAGATCTTTGGAACACTGTTTAGGTAGGGTGTTAAGACTTACAC<br>AGTACCTCGTTTCTACACAGAGAAAGAAATGGCCATACTTCAGGAACTGCAG<br>TGCTTATGAGGGGATATTTAGGCCTCTTGAATTTTTGATGTAGATGGGCATT<br>TTTTTAAGGTAGTGGTTAATTACCTTTATGTGAACTTTGAATGGTTTAACAA<br>AAGATTTGTTTTTGTAGAGATTTTAAAGGGGGAGAATTCTAGAAATAAATGT<br>TACCTAATTATTACAGCCTTAAAGACAAAAATCCTTGTTGAAGTTTTTTAA<br>AAAAAGCTAAATTACATAGACTTAGGCATTAACATGTTTGTGGAAGAATATA<br>GCAGACGTATATTGTATCATTTGAGTGAATGTTCCCAAGTAGGCATTCTAGG<br>CTCTATTTAACTGAGTCACACTGCATAGGAATTTAGAACCTAACTTTTATAG<br>GTTATCAAAACTGTTGTCACCATTGCACAATTTTGTCCTAATATATACATAG<br>AAACTTTGTGGGGCATGTTAAGTTACAGTTTGCACAAGTTCATCTCATTTGT<br>ATTCCATTGATTTTTTTTTCTTCTAAACATTTTTTCTTCAAACAGTATATA<br>ACTTTTTTTAGGGGATTTTTTTTAGACAGCAAAAACTATCTGAAGATTTCC<br>ATTTGTCAAAAAGTAATGATTTCTTGATAATTGTGTAGTAATGTTTTTTAGA<br>ACCCAGCAGTTACCTTAAAGCTGAATTTATATTTAGTAACTTCTGTGTTAAT<br>ACTGGATAGCATGAATTCTGCATTGAGAAACTGAATAGCTGTCATAAAATGA<br>AACTTTCTTTCTAAAGAAAGATACTCACATGAGTTCTTGAAGAATAGTCATA<br>ACTAGATTAAGATCTGTGTTTTAGTTTAATAGTTTGAAGTGCCTGTTTGGGA |

TABLE 3-continued

Exosome Targeting Domain

| Exosome Targeting Domain/Sticky Binder | Nucleic Acid Sequence (SEQ ID NO:) Amino Acid Sequence (SEQ ID NO:) |
|---|---|
| | TAATGATAGGTAATTTAGATGAATTTAGGGGAAAAAAAAGTTATCTGCAGAT<br>ATGTTGAGGGCCCATCTCTCCCCCCACACCCCCACAGAGCTAACTGGGTTAC<br>AGTGTTTTATCCGAAAGTTTCCAATTCCACTGTCTTGTGTTTTCATGTTGAA<br>AATACTTTTGCATTTTTCCTTTGAGTGCCAATTTCTTACTAGTACTATTTCT<br>TAATGTAACATGTTTACCTGGAATGTATTTTAACTATTTTTGTATAGTGTAA<br>ACTGAAACATGCACATTTTGTACATTGTGCTTTCTTTTGTGGGACATATGCA<br>GTGTGATCCAGTTGTTTTCCATCATTTGGTTGCGCTGACCTAGGAATGTTGG<br>TCATATCAAACATTAAAAATGACCACTCTTTTAATTGAAATTAACTTTTAAA<br>TGTTTATAGGAGTATGTGCTGTGAAGTGATCTAAAATTTGTAATATTTTTGT<br>CATGAACTGTACTACTCCTAATTATTGTAATGTAATAAAAATAGTTACAGTG<br>AC (SEQ ID NO: 211)<br>>NP_004976.2 GTPase KRas isoform b [Homo sapiens]<br>MTEYKLVVVGAGGVGKSALTIQLIQNHFVDEYDPTIEDSYRKQVVIDGETCL<br>LDILDTAGQEEYSAMRDQYMRTGEGFLCVFAINNTKSFEDIHHYREQIKRVK<br>DSEDVPMVLVGNKCDLPSRTVDTKQAQDLARSYGIPFIETSAKTRQGVDDAF<br>YTLVREIRKHKEKMSKDGKKKKKKSKTKCVIM (SEQ ID NO: 212)<br>>Lipid affinity tag nucleotide sequence<br>AAAAAGAAGAAAAAGAAGAAGAAGACAAAGTGTGTAATTATG<br>(SEQ ID NO: 213)<br>>Lipid affinity tag peptide sequence<br>KKKKKKKKTKCVIM (SEQ ID NO: 214) |
| Myr/Palm tag modified from Human MARCKS | >NM_002356.7 Homo sapiens myristoylated alanine rich protein kinase C substrate (MARCKS), mRNA<br>GCACTTGGGCGTTGGACCCCGCATCTTATTAGCAACCAGGGAGATTTCTCCA<br>TTTTCCTCTTGTCTACAGTGCGGCTACAAATCTGGGATTTTTTATTACTTC<br>TTTTTTTTTCGAACTACACTTGGGCTCCTTTTTTTGTGCTCGACTTTTCCAC<br>CCTTTTTCCCTCCCTCCTGTGCTGCTGCTTTTTGATCTCTTCGACTAAAATT<br>TTTTTATCCGGAGTGTATTTAATCGGTTCTGTTCTGTCCTCTCCACCACCCC<br>CACCCCCCTCCCTCCGGTGTGTGTGCCGCTGCCGCTGTTGCCGCCGCCGCTG<br>CTGCTGCTGCTCGCCCCGTCGTTACACCAACCCGAGGCTCTTTGTTTCCCCT<br>CTTGGATCTGTTGAGTTTCTTTGTTGAAGAAGCCAGCATGGGTGCCCAGTTC<br>TCCAAGACCGCAGCGAAGGGAGAAGCCGCCGGGAGAGGCCTGGGGAGGCGG<br>CTGTGGCCTCGTCGCCTTCCAAAGCGAACGGACAGGAGAATGGCCACGTGAA<br>GGTAAACGGCGACGCTTCGCCCGCGGCCGCCGAGTCGGGCGCCAAGGAGGAG<br>CTGCAGGCCAACGGCAGCGCCCCGGCCGCCGACAAGGAGGAGCCCGCGGCCG<br>CCGGGAGCGGGGCGGCGTCGCCCTCCGCGGCCGAGAAAGGTGAGCCGGCCGC<br>CGCCGCTGCCCCCGAGGCCGGGGCCAGCCCGGTAGAGAAGGAGGCCCCCGCG<br>GAAGGCGAGGCTGCCGAGCCCGGCTCGCCCACGGCCGCGGAGGGAGAGGCCG<br>CGTCGGCCGCCTCCTCGACTTCTTCGCCCAAGGCCGAGGACGGGGCCACGCC<br>CTCGCCCAGCAACGAGACCCCGAAAAAAAAAAAGAAGCGCTTTTCCTTCAAG<br>AAGTCTTTCAAGCTGAGCGGCTTCTCCTTCAAGAAGAACAAGAAGGAGGCTG<br>GAGAAGGCGGTGAGGCTGAGGCGCCCGCTGCCGAAGGCGGCAAGGACGAGGC<br>CGCCGGGGCGCAGCTGCGGCCGCCGCCGAGGCGGGCGCGGCCTCCGGGGAG<br>CAGGCAGCGGCGCCGGGCGAGGAGGCGGCAGCGGGCGAGGAGGGGGCGGCGG<br>GTGGCGACCCGCAGGAGGCCAAGCCCCAGGAGGCCGCTGTCGCGCCAGAGAA<br>GCCGCCCGCCAGCGACGAGACCAAGGCCGCCGAGGAGCCCAGCAAGGTGGAG<br>GAGAAAAAGGCCGAGGAGGCCGGGGCCAGCGCCGCCGCCTGCGAGGCCCCCT<br>CCGCCGCCGGGCCCGGCGCGCCCCCGGAGCAGGAGGCAGCCCCCGCGGAGGA<br>GCCCGCGGCCGCCGCAGCCTCGTCAGCCTGCGCAGCCCCCTCACAGGAGGCC<br>CAGCCCGAGTGCAGTCCAGAAGCCCCCCAGCGGAGGCGGCAGAGTAAAAGA<br>GCAAGCTTTTGTGAGATAATCGAAGAACTTTTCTCCCCCGTTTGTTTGTTGG<br>AGTGGTGCCAGGTACTGGTTTTGGAGAACTTGTCTACAACCAGGGATTGATT<br>TTAAAGATGTCTTTTTTTATTTTACTTTTTTTTAAGCACCAAATTTTGTTGT<br>TTTTTTTTTTCTCCCCTCCCCACAGATCCCATCTCAAATCATTCTGTTAAC<br>CACCATTCCAACAGGTCGAGGAGAGCTTAAACACCTTCTTCCTCTGCCTTGT<br>TTCTCTTTTATTTTTTATTTTTCGCATCAGTATTAATGTTTTTGCATACTT<br>TGCATCTTTATTCAAAAGTGTAAACTTTCTTTGTCAATCTATGGACATGCCC<br>ATATATGAAGGAGATGGGTGGGTCAAAAAGGGATATCAAATGAAGTGATGGG<br>GTCACAATGGGGAAATTGAAGTGGTGCATAACATTGCCAAAATAGTGTGCCA<br>CTAGAAATGGTGTAAAGGCTGTCTTTTTTTTTTTTAAAAGAAAAGTTATT<br>ACCATGTATTTTGTGAGGCAGGTTTACAACACTACAAGTCTTGAGTTAAGAA<br>GGAAAGAGGAAAAAGAAAAAACACCAATACCCAGATTTAAAAAAAAAAAA<br>CGATCATAGTCTTAGGAGTTCATTTAAACCATAGGAACTTTTCACTTATCTC<br>ATGTTAGCTGTACCAGTCAGTGATTAAGTAGAACTACAAGTTGTATAGGCTT<br>TATTGTTTATTGCTGGTTTATGACCTTAATAAAGTGTAATTATGTATTACCA<br>GCAGGGTGTTTTAACTGTGACTATTGTATAAAAACAAATCTTGATATCCAG<br>AAGCACATGAAGTTTGCAACTTTCCACCCTGCCCATTTTTGTAAAACTGCAG<br>TCATCTTGGACCTTTTAAAACACAAATTTTAAACTCAACCAAGCTGTGATAA<br>GTGGAATGGTTACTGTTTATACTGTGGTATGTTTTTGATTACAGCAGATAAT<br>GCTTTCTTTTCCAGTCGTCTTTGAGAATAAAGGAAAAAAAATCTTCAGATGC<br>AATGGTTTTGTGTAGCATCTTGTCTATCATGTTTTGTAAATACTGGAGAAGC<br>TTTGACCAATTTGACTTAGAGATGGAATGTAACTTTGCTTACAAAAATTGCT<br>ATTAAACTCCTGCTTAAGGTGTTCTAATTTTCTGTGAGCACACTAAAAGCGA |

TABLE 3-continued

Exosome Targeting Domain

| Exosome Targeting Domain/Sticky Binder | Nucleic Acid Sequence (SEQ ID NO:)<br>Amino Acid Sequence (SEQ ID NO:) |
|---|---|
| | AAAATAAATGTGAATAAAATGTACAAATTTGTTGTGTTTTTTATGTTCTAA<br>TAATACTGAGACTTCTAGGTCTTAGGTTAATTTTTAGGAAGATCTTGCATGC<br>CATCAGGAGTAAATTTTATTGTGGTTCTTAATCTGAAGTTTTCAAGCTCTGA<br>AATTCATAATCCGCAGTGTCAGATTACGTAGAGGAAGATCTTACAACATTTC<br>CATGTCAAATCTGTTACCATTTATTGGCATTTAGTTTTCATTTAAGAATTGA<br>ACATAATTATTTTTATTGTAGCTATATAGCATGTCAGATTAAATCATTTACA<br>ACAAAAGGGGTGTGAACCTAAGACTATTTAAATGTCTTATGAGAAAATTTCA<br>TAAAGCCATTCTCTTGTCATTCAGGTCCAGAAACAAATTTTAAACTGAGTGA<br>GAGTCTATAGAATCCATACTGCAGATGGGTCATGAAATGTGACCAAATGTGT<br>TTCAAAAATTGATGGTGTATTACCTGCTATTGTAATTGCTTAGTGCTTGGCT<br>AATTTCCAAATTATTGCATAATATGTTCTACCTTAAGAAAACAGGTTTATGT<br>AACAAAGTAATGGTGTTGAATGGATGATGTCAGTTCATGGGCCTTTAGCATA<br>GTTTTAAGCATCCTTTTTTTTTTTTTTTGAAAGTGTGTTAGCATCTTGT<br>TACTCAAAGGATAAGACAGACAATAATACTTCACTGAATCTTAATAATCTTT<br>ACTAGTTTACCTCCTCTGCTCTTTGCCACCCGATAACTGGATATCTTTTCCT<br>TCAAAGGACCCTAAACTGATTGAAATTTAAGATATGTATCAAAAACATTATT<br>TCATTTAATGCACATCTGTTTGCTGTTTTTGAGCAGTGTGCAGTTTAGGGT<br>TCATGATAAATCATTGAACCACATGTGTAACAACTGAATGCCAAATCTTAAA<br>CTCATTAGAAAAATAACAAATTAGGTTTTGACACGCATTCTTAATTGGAATA<br>ATGGATCAAAAATAGTGGTTCATGACCTTACCAAACACCCTTGCTACTAATA<br>AAATCAAATAACACTTAGAAGGGTATGTATTTTTAGTTAGGGTTTCTTGATC<br>TTGGAGGATGTTTGAAAGTTAAAAATTGAATTTGGTAACCAAAGGACTGATT<br>TATGGGTCTTTCCTATCTTAACCAACGTTTTCTTAGTTACCTAGATGGCCAA<br>GTACAGTGCCTGGTATGTAGTAAGACTCAGTAAAAAAGTGGATTTTTAAAAA<br>TAACTCCCAAAGTGAATAGTCAAAAATCCTGTTAGCAAACTGTTATATATTG<br>CTAAGTTTGTTCTTTTAACAGCTGGAATTTATTAAGATGCATTATTTTGATT<br>TTATTCACTGCCTAAAACACTTTGGGTGGTATTGATGGAGTTGGTGGATTTT<br>CCTCCAAGTGATTAAATGAAATTTGACGTATCTTTTCATCCAAAGTTTTGTA<br>CATCATGTTTTCTAACGGAAAAAAATGTTAATATGGCTTTTTTGTATTACTA<br>AAAATAGCTTTGAGATTAAGGAAAAATAAATAACTCTTGTACAGTTCAGTAT<br>TGTCTATTAAATCTGTATTGGCAGTATGTATAATGGCATTTGCTGTGGTTAC<br>AAAATACTTCCTCTGGGTTATAATAATCATTTGATCCAATTCCTATTGCTTG<br>TAAAATAAAGTTTTACCAGTTGATATAATCAA (SEQ ID NO: 215)<br>>NP_002347.5 myristoylated alanine-rich C-kinase<br>substrate [Homo sapiens]<br>MGAQFSKTAAKGEAAAERPGEAAVASSPSKANGQENGHVKVNGDASPAAAES<br>GAKEELQANGSAPAADKEEPAAAGSGAASPSAAEKGEPAAAAAPEAGASPVE<br>KEAPAEGEAAEPGSPTAAEGEAASAASSTSSPKAEDGATPSPSNETPKKKKK<br>RFSFKKSFKLSGFSFKKNKKEAGEGGEAEAPAAEGGKDEAAGGAAAAAAEAG<br>AASGEQAAAPGEEAAAGEEGAAGGDPQEAKPQEAAVAPEKPPASDETKAAEE<br>PSKVEEKKAEEAGASAAACEAPSAAGPGAPPEQEAAPAEEPAAAAASSACAA<br>PSQEAQPECSPEAPPAEAAE (SEQ ID NO: 216)<br>>Myr/Palm tag modified from Human MARCKS, nucleotide<br>sequence<br>ATGGGT<u>TGCTGT</u>TTCTCCAAGACC (SEQ ID NO: 217)<br>>Myr/Palm tag modified from Human MARCKS, peptide<br>sequence<br>MG<u>CC</u>FSKT (SEQ ID NO: 218) |

In some embodiments of any of the aspects provided herein, the fusion polypeptide further comprises a peptide linker. The linker may be flexible, rigid, or cleavable. Further, the linker can be linked directly or via another linker (e.g., a peptide of one, two, three, four, five, six, seven, eight, nine, ten or more amino acids) to the fusion polypeptides described herein. Linkers can be configured according to a specific need, e.g., based on at least one of the following characteristics. In some embodiments of any of the aspects, linkers can be configured to have a sufficient length and flexibility such that it can allow for a cleavage at a target site. In some embodiments of any of the aspects, linkers can be configured to allow multimerization of the fusion polypeptides provided herein. In some embodiments of any of the aspects, linkers can be configured to facilitate expression and purification of the fusion proteins or engineered extracellular vesicles provided herein.

In some embodiments of any of the aspects, a linker can be configured to have any length in a form of a peptide, peptidomimetic, an aptamer, a protein, a nucleic acid (e.g., DNA or RNA), or any combinations thereof. For example, in one embodiment, the linker may be a polypeptide linker such as Gly-Ser-Ser-Gly or a variation thereof as known by one of ordinary skill in the art. In another embodiment the linker may be a protein sequence for a self-cleavable peptide. For example, 2A sequences such as P2A, E2A, F2A, and T2A code for self-cleavable peptides by inducing ribosomal slippage on the mRNA at the 2A site which prevents peptide bond formation. The slippage will result in two separate peptides after translation. This allows the expression of two separate proteins from one promoter region. Any combination of the proteins described herein may be expressed with a self-cleavable peptide as known by one of ordinary skill in the art.

In some embodiments of any of the aspects, the polypeptide linker is a non-cleavable linker. In some embodiments of any of the aspects, a linker can be a chemical linker of any length.

In some embodiments of any of the aspects, the linker is an Fc linker. An exemplary nucleic acid sequence encoding an Fc polypeptide is:

```
>KY053479.1 Synthetic construct Fc-adiponectin
gene, complete cds
                                         (SEQ ID NO: 219)
ATGTACAGGATGCAACTCCTGTCTTGCATTGCACTAAGTCTTGCACTTGTC
ACGAACTCGATATCGGCCATGGTTAGATCTGACAAAACTCACACATGCCCA
CCGTGCCCAGCACCTGAACTCCTGGGGGGACCGTCAGTCTTCCTCTTCCCC
CCAAAACCCAAGGACACCCTCATGATCTCCCGGACCCCTGAGGTCACATGC
GTGGTGGTGGACGTGAGCCACGAAGACCCTGAGGTCAAGTTCAACTGGTAC
GTGGACGGCGTGGAGGTGCATAATGCCAAGACAAAGCCGCGGGAGGAGCAG
TACAACAGCACGTACCGTGTGGTCAGCGTCCTCACCGTCCTGCACCAGGAC
TGGCTGAATGGCAAGGAGTACAAGTGCAAGGTCTCCAACAAAGCCCTCCCA
GCCCCCATCGAGAAAACCATCTCCAAAGCCAAAGGGCAGCCCCGAGAACCA
CAGGTGTACACCCTGCCCCCATCCCGGGAGGAGATGACCAAGAACCAGGTC
AGCCTGACCTGCCTGGTCAAAGGCTTCTATCCCAGCGACATCGCCGTGGAG
TGGGAGAGCAATGGGCAGCCGGAGAACAACTACAAGACCACGCCTCCCGTG
CTGGACTCCGACGGCTCCTTCTTCCTCTACAGCAAGCTCACCGTGGACAAG
AGCAGGTGGCAGCAGGGGAACGTCTTCTCATGCTCCGTGATGCACGAGGCT
CTGCACAACCACTACACGCAGAAGAGCCTCTCCCTGTCTCCGGGTAAAGCC
AGCGGAAGTGGCGGAGGAGGCGGTCCTGGAGAAGGTGCCTATGTATACCGC
TCAGCATTCAGTGTGGGATTGGAGACTTACGTTACTATCCCCAACATGCCC
ATTCGCTTTACCAAGATCTTCTACAATCAGCAAAACCACTATGATGGCTCC
ACTGGTAAATTCCACTGCAACATTCCTGGGCTGTACTACTTTGCCTACCAC
ATCACAGTCTATATGAAGGATGTGAAGGTCAGCCTCTTCAAGAAGGACAAG
GCTATGCTCTTCACCTATGATCAGTACCAGGAAATAATGTGGACCAGGCC
TCCGGCTCTGTGCTCCTGCATCTGGAGGTGGGCGACCAAGTCTGGCTCCAG
GTGTATGGGAAGGAGAGCGTAATGGACTCTATGCTGATAATGACAATGAC
TCCACCTTCACAGGCTTTCTTCTCTACCATGACACCAACTCTAGAAAGCTT
CCTGGAGAAGGTGCCTATGTATACCGCTCAGCATTCAGTGTGGGATTGGAG
ACTTACGTTACTATCCCCAACATGCCCATTCGCTTTACCAAGATCTTCTAC
AATCAGCAAAACCACTATGATGGCTCCACTGGTAAATTCCACTGCAACATT
CCTGGGCTGTACTACTTTGCCTACCACATCACAGTCTATATGAAGGATGTG
AAGGTCAGCCTCTTCAAGAAGGACAAGGCTATGCTCTTCACCTATGATCAG
TACCAGGAAATAATGTGGACCAGGCCTCCGGCTCTGTGCTCCTGCATCTG
GAGGTGGGCGACCAAGTCTGGCTCCAGGTGTATGGGAAGGAGAGCGTAAT
GGACTCTATGCTGATAATGACAATGACTCCACCTTCACAGGCTTTCTTCTC
TACCATGACACCAACACTAGTCCTGGAGAAGGTGCCTATGTATACCGCTCA
GCATTCAGTGTGGGATTGGAGACTTACGTTACTATCCCCAACATGCCCATT
CGCTTTACCAAGATCTTCTACAATCAGCAAAACCACTATGATGGCTCCACT
GGTAAATTCCACTGCAACATTCCTGGGCTGTACTACTTTGCCTACCACATC
ACAGTCTATATGAAGGATGTGAAGGTCAGCCTCTTCAAGAAGGACAAGGCT
ATGCTCTTCACCTATGATCAGTACCAGGAAATAATGTGGACCAGGCCTCC
GGCTCTGTGCTCCTGCATCTGGAGGTGGGCGACCAAGTCTGGCTCCAGGTG
TATGGGAAGGAGAGCGTAATGGACTCTATGCTGATAATGACAATGACTCC
ACCTTCACAGGCTTTCTTCTCTACCATGACACCAACTAA.
```

The amino acid sequence of the Fc linker is:

```
>Fc Translation
                                         (SEQ ID NO: 220)
DKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCK
VSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFS
CSVMHEALHNHYTQKSLSLSPGK.
```

In some embodiments of any of the aspects, the linker is a P2A peptide linker. P2A is a self-cleaving peptide sequence allowing for expression of two proteins from one promoter. In some embodiments, the P2A linker is encoded by the nucleic acid sequence:

```
                                         (SEQ ID NO: 221)
        GCTACTAACTTCAGCCTGCTGAAGCAG.
```

The amino acid sequence of P2A is

```
                                         (SEQ ID No: 222)
                ATNFSLKQAGDVENPGP.
```

In some embodiments of any of the aspects, the linker is provides a multimerization (e.g., dimerization) domain wherein one fusion polypeptide may connect with another fusion polypeptide at each fusion polypeptide's respective multimerization domain. Multimerization of multiple fusion polypeptides will provide multiple fusion polypeptides within close proximity to one another to one or more a target receptor on the target cell, wherein the multiple fusion peptides will enhance receptor clustering on the target cell. Clustering receptors on a target cell will result in enhanced signal transduction. Without receptor clustering a signal may be weaker or not occur all together. For example, Fc domain sequences presented herein dimerize resulting in two fusion polypeptides connected by a covalent bond via the two Fc domains on their respective fusion polypeptide. One preferred embodiment of an Fc domain is from IgG4, herein labeled 4Fc. In other embodiments Fc may be from IgG1, herein labeled Fc. In certain embodiments Fc from other immunoglobulin, (e.g., IgG2, IgG3, etc.) may be used.

Additional non-limiting examples of linkers that can be used and their properties are further described in detail, e.g., in Chen X, Zaro J L, Shen W C. Fusion protein linkers: property, design and functionality. *Adv Drug Deliv Rev.* 2013; 65(10): 1357-1369. doi: 10.1016/j.addr.2012.09.039; O'Shea E K, Lumb K J, Kim P S. Peptide 'Velcro': design of a heterodimeric coiled coil. Curr Biol. 1993 Oct. 1; 3(10):658-67. doi: 10.1016/0960-9822(93)90063-t. PMID: 15335856; and Müller K M, Arndt K M, Alber T. Protein fusions to coiled-coil domains. Methods Enzymol. 2000; 328:261-82. doi: 10.1016/s0076-6879(00)28402-4. PMID: 11075350, the contents of which are incorporated herein by reference in their entireties.

The engineered extracellular vesicle compositions provided herein can comprise variations in the configuration of the POI domain, linkers, and/or vesicle targeting domain. The specific combination and localization of these domains can enhance fusion polypeptide anchoring, function, or therapeutic effect, e.g., modulating inflammation.

Thus, in one aspect, provided herein is an engineered extracellular vesicle comprising: at least one fusion polypeptide comprising: (i) at least one protein of interest (POI) domain or a fragment thereof; and (ii) at least one vesicle targeting domain, wherein the POI domain is in an extracellular position relative to a lipid membrane of the extracellular vesicle.

In some embodiments, the POI domain or a fragment thereof is a N-terminal domain of the fusion polypeptide. In some embodiments, the vesicle targeting domain or a fragment thereof is a C-terminal domain of the fusion polypeptide.

In another aspect, provided herein is an engineered extracellular vesicle comprising: at least one fusion polypeptide comprising: (i) at least one protein of interest (POI) domain or a fragment thereof; and (ii) at least one vesicle targeting domain, wherein the POI domain is in an extracellular position relative to a lipid membrane of the extracellular vesicle, and wherein the vesicle targeting domain is a transmembrane domain relative to a lipid membrane of the extracellular vesicle.

In some embodiments, the POI domain or a fragment thereof is a C-terminal domain of the fusion polypeptide. In some embodiments, the vesicle targeting domain or a fragment thereof is a N-terminal domain of the fusion polypeptide. In some embodiments, the vesicle targeting domain is in a luminal position relative to the lipid membrane of the extracellular vesicle.

In some embodiments, the linker is in an exterior position relative to the lipid membrane of the extracellular vesicle. In some embodiments, the linker is a transmembrane linker. In some embodiments, the linker is in a luminal position relative to the lipid membrane of the extracellular vesicle.

The engineered extracellular vesicle compositions provided herein can comprise one or more of the following fusion polypeptide sequences in Table 4.

TABLE 4

Full Length Constructs

| Fusion Polypeptide | Nucleic Acid Sequence (SEQ ID NO:) Amino Acid Sequence (SEQ ID NO:) |
|---|---|
| hCTLA4-Fc-GPI | >Artificial sequence; hCTLA4-Fc-GPI, DNA<br>ATGGCTTGCCTTGGATTTCAGCGGCACAAGGCTCAGCTGAACCTGGCTACCAGGACC<br>TGGCCCTGCACTCTCCTGTTTTTTCTTCTCTTCATCCCTGTCTTCTGCAAAGCAATG<br>CACGTGGCCCAGCCTGCTGTGGTACTGGCCAGCAGCCGAGGCATCGCCAGCTTTGTG<br>TGTGAGTATGCATCTCCAGGCAAAGCCACTGAGGTCCGGGTGACAGTGCTTCGGCAG<br>GCTGACAGCCAGGTGACTGAAGTCTGTGCGGCAACCTACATGATGGGGAATGAGTTG<br>ACCTTCCTAGATGATTCCATCTGCACGGGCACCTCCAGTGGAAATCAAGTGAACCTC<br>ACTATCCAAGGACTGAGGGCCATGGACACGGGACTCTACATCTGCAAGGTGGAGCTC<br>ATGTACCCACCGCCATACTACCTGGGCATAGGCAACGGAACCCAGATTTATGTAATT<br>GATCCAGAACCGTGCCCAGATTCTGACATCGAT<u>GACAAAACTCACACATGCCCACCG</u><br><u>TGCCCAGCACCTGAACTCCTGGGGGGACCGTCAGTCTTCCTCTTCCCCCCAAAACCC</u><br><u>AAGGACACCCTCATGATCTCCCGGACCCCTGAGGTCACATGCGTGGTGGTGGACGTG</u><br><u>AGCCACGAAGACCCTGAGGTCAAGTTCAACTGGTACGTGGACGGCGTGGAGGTGCAT</u><br><u>AATGCCAAGACAAAGCCGCGGGAGGAGCAGTACAACAGCACGTACCGTGTGGTCAGC</u><br><u>GTCCTCACCGTCCTGCACCAGGACTGGCTGAATGGCAAGGAGTACAAGTGCAAGGTC</u><br><u>TCCAACAAAGCCCTCCCAGCCCCCATCGAGAAAACCATCTCCAAAGCCAAAGGGCAG</u><br><u>CCCCGAGAACCACAGGTGTACACCCTGCCCCCATCCCGGGAGGAGATGACCAAGAAC</u><br><u>CAGGTCAGCCTGACCTGCCTGGTCAAAGGCTTCTATCCCAGCGACATCGCCGTGGAG</u><br><u>TGGGAGAGCAATGGGCAGCCGGAGAACAACTACAAGACCACGCCTCCCGTGCTGGAC</u><br><u>TCCGACGGCTCCTTCTTCCTCTACAGCAAGCTCACCGTGGACAAGAGCAGGTGGCAG</u><br><u>CAGGGGAACGTCTTCTCATGCTCCGTGATGCACGAGGCTCTGCACAACCACTACACG</u><br><u>CAGAAGAGCCTCTCCCTGTCTCCGGGTAAA</u>ATCGAT*CCAAATAAAGGAAGTGGAACC*<br>*ACTTCAGGTACTACCCGTCTTCTATCTGGGCACACGTGTTTCACGTTGACAGGTTTG*<br>*CTTGGGACGCTAGTAACCATGGGCTTGCTGACTTAG*<br>(SEQ ID NO: 223)<br>> Artificial sequence; hCTLA4-Fc-GPI, Amino Acid<br>MACLGFQRHKAQLNLATRTWPCTLLFFLLFIPVFCKAMHVAQPAVVLASSRGIASFV<br>CEYASPGKATEVRVTVLRQADSQVTEVCAATYMMGNELTFLDDSICTGTSSGNQVNL<br>TIQGLRAMDTGLYICKVELMYPPPYYLGIGNGTQIYVIDPEPCPDSDID<u>DKTHTCPP</u><br><u>CPAPELLGGPSVFLFPPKPKDTLMISRTPEVTCVVVDVSHEDPEVKFNWYVDGVEVH</u><br><u>NAKTKPREEQYNSTYRVVSVLTVLHQDWLNGKEYKCKVSNKALPAPIEKTISKAKGQ</u><br><u>PREPQVYTLPPSREEMTKNQVSLTCLVKGFYPSDIAVEWESNGQPENNYKTTPPVLD</u><br><u>SDGSFFLYSKLTVDKSRWQQGNVFSCSVMHEALHNHYTQKSLSLSPGKID</u>*PNKGSGT*<br>*TSGTTRLLSGHTCFTLTGLLGTLVTMGLLT*<br>(SEQ ID NO: 224) |
| hPDL1-GPI | > Artificial sequence; hPDL1-GPI, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTGAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCCAAGAGAGGAGAAGCTT<br>TTCAATGTGACCAGCACACTGAGAATCAACACAACAACTAATGAGATTTTCTACTGC |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | ACTTTTAGGAGATTAGATCCTGAGGAAAACCATACAGCTGAATTGGTCATCCCAGAA<br>CTACCTCTGGCACATCCTCCAAATGAAAGG*CCAAATAAAGGAAGTGGAACCACTTCA*<br>*GGTACTACCCGTCTTCTATCTGGGCACACGTGTTTCACGTTGACAGGTTTGCTTGGG*<br>*ACGCTAGTAACCATGGGCTTGCTGACTTAG*<br>(SEQ ID NO: 225)<br>>Amino Acid Sequence; hPDL1-GPI, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPE<br>LPLAHPPNER*PNKGSGTTSGTTRLLSGHTCFTLTGLLGTLVTMGLLT*<br>(SEQ ID NO: 226) |
| hPDL1-C1C2 | >Artificial Sequence; hPDL1-*C1C2*, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCCAAGAGAGAGGAGAAGCTT<br>TTCAATGTGACCAGCACACTGAGAATCAACACAACAACTAATGAGATTTTCTACTGC<br>ACTTTTAGGAGATTAGATCCTGAGGAAAACCATACAGCTGAATTGGTCATCCCAGAA<br>CTACCTCTGGCACATCCTCCAAATGAAAGG*ATCGATGTCGAGCCACTGGGCATGGAG*<br>*AATGGGAACATTGCCAACTCACAGATCGCCGCCTCATCTGTGCGTGTGACCTTCTTG*<br>*GGTTTTGCAGCATTGGGTCCCGGAGCTGGCCCGCCTGAACCGCGCAGGCATGGTCAAT*<br>*GCCTGGACACCCAGCAGCAATGACGATAACCCCTGGATCCAGGTGAACCTGCTGCGG*<br>*AGGATGTGGGTAACAGGTGTGGTGACGCAGGGTGCCAGCCGCTTGGCCAGTCATGAG*<br>*TACCTGAAGGCCTTCAAGGTGGCCTACAGCCTTAATGGACACGAATTCGATTTCATC*<br>*CATGATGTTAATAAAAAACACAAGGAGTTTGTGGGTAACTGGAACAAAAACGCGGTG*<br>*CATGTCAACCTGTTTGAGACCCCTGTGGAGGCTCAGTACGTGAGATTGTACCCCACG*<br>*AGCTGCCACACGGCCTGCACTCTGCGCTTTGAGCTACTGGGCTGTGAGCTGAACGGA*<br>*TGCGCCAATCCCCTGGGCCTGAAGAATAACAGCATCCCTGACAAGCAGATCACGGCC*<br>*TCCAGCAGCTACAAGACCTGGGGCTTGCATCTCTTCAGCTGGAACCCCTCCTATGCA*<br>*CGGCTGGACAAGCAGGGCAACTTCAACGCCTGGGTTGCGGGGAGCTACGGTAACGAT*<br>*CAGTGGCTGCAGATCTTCCCTGGCAACTGGGACAACCACTCCCACAAGAAGAACTTG*<br>*TTTGAGACGCCCATCCTGGCTCGCTATGTGCGCATCCTGCCTGTAGCCTGGCACAAC*<br>*CGCATCGCCCTGCGCCTGGAGCTGCTGGGCTGTTAG*<br>(SEQ ID NO: 227)<br>>Artificial Sequence, hPDL1-*C1C2*, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPE<br>LPLAHPPNER*IDVEPLGMENGNIANSQIAASSVRVTFLGLQHWVPELARLNRAGMVN*<br>*AWTPSSNDDNPWIQVNLLRRMWVTGVVTQGASRLASHEYLKAFKVAYSLNGHEFDFI*<br>*HDVNKKHKEFVGNWNKNAVHVNLFETPVEAQYVRLYPTSCHTACTLRFELLGCELNG*<br>*CANPLGLKNNSIPDKQITASSSYKTWGLHLFSWNPSYARLDKQGNFNAWVAGSYGND*<br>*QWLQIFPGNWDNHSHKKNLFETPILARYVRILPVAWHNRIALRLELLGC*<br>(SEQ ID NO: 228) |
| hPDL1-Fc-GPI | >Artificial Sequence; hPDL1-Fc-GPI, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCCAAGAGAGAGGAGAAGCTT<br>TTCAATGTGACCAGCACACTGAGAATCAACACAACAACTAATGAGATTTTCTACTGC<br>ACTTTTAGGAGATTAGATCCTGAGGAAAACCATACAGCTGAATTGGTCATCCCAGAA<br>CTACCTCTGGCACATCCTCCAAATGAAAGG<u>ATCGATGACAAAACTCACACATGCCCA</u><br><u>CCGTGCCCAGCACCTGAACTCCTGGGGGGACCGTCAGTCTTCCTCTTCCCCCCAAAA</u><br><u>CCCAAGGACACCCTCATGATCTCCCGGACCCCTGAGGTCACATGCGTGGTGGTGGAC</u><br><u>GTGAGCCACGAAGACCCTGAGGTCAAGTTCAACTGGTACGTGGACGGCGTGGAGGTG</u><br><u>CATAATGCCAAGACAAAGCCGCGGGAGGAGCAGTACAACAGCACGTACCGTGTGGTC</u><br><u>AGCGTCCTCACCGTCCTGCACCAGGACTGGCTGAATGGCAAGGAGTACAAGTGCAAG</u><br><u>GTCTCCAACAAAGCCCTCCCAGCCCCCATCGAGAAAACCATCTCCAAAGCCAAAGGG</u><br><u>CAGCCCCGAGAACCACAGGTGTACACCCTGCCCCCATCCCGGGAGGAGATGACCAAG</u> |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | AACCAGGTCAGCCTGACCTGCCTGGTCAAAGGCTTCTATCCCAGCGACATCGCCGTG<br>GAGTGGGAGAGCAATGGGCAGCCGGAGAACAACTACAAGACCACGCCTCCCGTGCTG<br>GACTCCGACGGCTCCTTCTTCCTCTACAGCAAGCTCACCGTGGACAAGAGCAGGTGG<br>CAGCAGGGGAACGTCTTCTCATGCTCCGTGATGCACGAGGCTCTGCACAACCACTAC<br>ACGCAGAAGAGCCTCTCCCTGTCTCCGGGTAAAATCGATCCAAATAAAGGAAGTGGA<br>ACCACTTCAGGTACTACCCGTCTTCTATCTGGGCACACGTGTTTCACGTTGACAGGT<br>TTGCTTGGGACGCTAGTAACCATGGGCTTGCTGACTTAG<br>(SEQ ID NO: 229)<br>> Artificial Sequence; hPDL1-Fc-*GPI*, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPE<br>LPLAHPPNERIDDKTHTCPPCPAPELLGGPSVFLFPPKPKDTLMISRTPEVTCVVVD<br>VSHEDPEVKFNWYVDGVEVHNAKTKPREEQYNSTYRVVSVLTVLHQDWLNGKEYKCK<br>VSNKALPAPIEKTISKAKGQPREPQVYTLPPSREEMTKNQVSLTCLVKGFYPSDIAV<br>EWESNGQPENNYKTTPPVLDSDGSFFLYSKLTVDKSRWQQGNVFSCSVMHEALHNHY<br>TQKSLSLSPGKID*PNKGSGTTSGTTRLLSGHTCFTLTGLLGTLVTMGLLT*<br>(SEQ ID NO: 230) |
| hPDL2-C1C2 | >Artificial Sequence; hPDL2-*C1C2*, DNA<br>ATGATCTTCCTCCTGCTAATGTTGAGCCTGGAATTGCAGCTTCACCAGATAGCAGCT<br>TTATTCACAGTGACAGTCCCTAAGGAACTGTACATAATAGAGCATGGCAGCAATGTG<br>ACCCTGGAATGCAACTTTGACACTGGAAGTCATGTGAACCTTGGAGCAATAACAGCC<br>AGTTTGCAAAAGGTGGAAAATGATACATCCCCACACCGTGAAAGAGCCACTTTGCTG<br>GAGGAGCAGCTGCCCCTAGGGAAGGCCTCGTTCCACATACCTCAAGTCCAAGTGAGG<br>GACGAAGGACAGTACCAATGCATAATCATCTATGGGGTCGCCTGGGACTACAAGTAC<br>CTGACTCTGAAAGTCAAAGCTTCCTACAGGAAAATAAACACTCACATCCTAAAGGTT<br>CCAGAAACAGATGAGGTAGAGCTCACCTGCCAGGCTACAGGTTATCCTCTGGCAGAA<br>GTATCCTGGCCAAACGTCAGCGTTCCTGCCAACACCAGCCACTCCAGGACCCCTGAA<br>GGCCTCTACCAGGTCACCAGTGTTCTGCGCCTAAAGCCACCCCCTGGCAGAAACTTC<br>AGCTGTGTGTTCTGGAATACTCACGTGAGGGAACTTACTTTGGCCAGCATTGACCTT<br>CAAAGTCAGATGGAACCCAGGACCCATCCAACT*ATCGATGTCGAGCCACTGGGCATG<br>GAGAATGGGAACATTGCCAACTCACAGATCGCCGCCTCATCTGTGCGTGTGACCTTC<br>TTGGGTTTGCAGCATTGGGTCCCGGAGCTGGCCCGCCTGAACCGCGCAGGCATGGTC<br>AATGCCTGGACACCCAGCAGCAATGACGATAACCCCTGGATCCAGGTGAACCTGCTG<br>CGGAGGATGTGGGTAACAGGTGTGGTGACGCAGGGTGCCAGCCGCTTGGCCAGTCAT<br>GAGTACCTGAAGGCCTTCAAGGTGGCCTACAGCCTTAATGGACACGAATTCGATTTC<br>ATCCATGATGTTAATAAAAAACACAAGGAGTTTGTGGGTAACTGGAACAAAAACGCG<br>GTGCATGTCAACCTGTTTGAGACCCCTGTGGAGGCTCAGTACGTGAGATTGTACCCC<br>ACGAGCTGCCACACGGCCTGCACTCTGCGCTTTGAGCTACTGGGCTGTGAGCTGAAC<br>GGATGCGCCAATCCCCTGGGCCTGAAGAATAACAGCATCCCTGACAAGCAGATCACG<br>GCCTCCAGCAGCTACAAGACCTGGGGCTTGCATCTCTTCAGCTGGAACCCCTCCTAT<br>GCACGGCTGGACAAGCAGGGCAACTTCAACGCCTGGGTTGCGGGGAGCTACGGTAAC<br>GATCAGTGGCTGCAGATCTTCCCTGGCAACTGGGACAACCACTCCCACAAGAAGAAC<br>TTGTTTGAGACGCCCATCCTGGCTCGCTATGTGCGCATCCTGCCTGTAGCCTGGCAC<br>AACCGCATCGCCCTGCGCCTGGAGCTGCTGGGCTGTTAG*<br>(SEQ ID NO: 231)<br>>Artificial Sequence; hPDL2-*C1C2*, Amino Acid<br>MIFLLLMLSLELQLHQIAALFTVTVPKELYIIEHGSNVTLECNFDTGSHVNLGAITA<br>SLQKVENDTSPHRERATLLEEQLPLGKASFHIPQVQVRDEGQYQCIIIYGVAWDYKY<br>LTLKVKASYRKINTHILKVPETDEVELTCQATGYPLAEVSWPNVSVPANTSHSRTPE<br>GLYQVTSVLRLKPPPGRNFSCVFWNTHVRELTLASIDLQSQMEPRTHPT*IDVEPLGM<br>ENGNIANSQIAASSVRVTFLGLQHWVPELARLNRAGMVNAWTPSSNDDNPWIQVNLL<br>RRMWVTGVVTQGASRLASHEYLKAFKVAYSLNGHEFDFIHDVNKKHKEFVGNWNKNA<br>VHVNLFETPVEAQYVRLYPTSCHTACTLRFELLGCELNGCANPLGLKNNSIPDKQIT<br>ASSSYKTWGLHLFSWNPSYARLDKQGNFNAWVAGSYGNDQWLQIFPGNWDNHSHKKN<br>LFETPILARYVRILPVAWHNRIALRLELLGC*<br>(SEQ ID NO: 232) |
| hPDL2-Fc-GPI | >Artificial Sequence; hPDL2-Fc-*GPI*, DNA<br>ATGATCTTCCTCCTGCTAATGTTGAGCCTGGAATTGCAGCTTCACCAGATAGCAGCT<br>TTATTCACAGTGACAGTCCCTAAGGAACTGTACATAATAGAGCATGGCAGCAATGTG<br>ACCCTGGAATGCAACTTTGACACTGGAAGTCATGTGAACCTTGGAGCAATAACAGCC<br>AGTTTGCAAAAGGTGGAAAATGATACATCCCCACACCGTGAAAGAGCCACTTTGCTG<br>GAGGAGCAGCTGCCCCTAGGGAAGGCCTCGTTCCACATACCTCAAGTCCAAGTGAGG<br>GACGAAGGACAGTACCAATGCATAATCATCTATGGGGTCGCCTGGGACTACAAGTAC<br>CTGACTCTGAAAGTCAAAGCTTCCTACAGGAAAATAAACACTCACATCCTAAAGGTT<br>CCAGAAACAGATGAGGTAGAGCTCACCTGCCAGGCTACAGGTTATCCTCTGGCAGAA<br>GTATCCTGGCCAAACGTCAGCGTTCCTGCCAACACCAGCCACTCCAGGACCCCTGAA<br>GGCCTCTACCAGGTCACCAGTGTTCTGCGCCTAAAGCCACCCCCTGGCAGAAACTTC<br>AGCTGTGTGTTCTGGAATACTCACGTGAGGGAACTTACTTTGGCCAGCATTGACCTT<br>CAAAGTCAGATGGAACCCAGGACCCATCCAACTATCGAT<u>GACAAAACTCACACATGC<br>CCACCGTGCCCAGCACCTGAACTCCTGGGGGACCGTCAGTCTTCCTCTTCCCCCCA<br>AAACCCAAGGACACCCTCATGATCTCCCGGACCCCTGAGGTCACATGCGTGGTGGTG</u> |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | GACGTGAGCCACGAAGACCCTGAGGTCAAGTTCAACTGGTACGTGGACGGCGTGGAG<br>GTGCATAATGCCAAGACAAAGCCGCGGGAGGAGCAGTACAACAGCACGTACCGTGTG<br>GTCAGCGTCCTCACCGTCCTGCACCAGGACTGGCTGAATGGCAAGGAGTACAAGTGC<br>AAGGTCTCCAACAAAGCCCTCCCAGCCCCCATCGAGAAAACCATCTCCAAAGCCAAA<br>GGGCAGCCCCGAGAACCACAGGTGTACACCCTGCCCCCATCCCGGGAGGAGATGACC<br>AAGAACCAGGTCAGCCTGACCTGCCTGGTCAAAGGCTTCTATCCCAGCGACATCGCC<br>GTGGAGTGGGAGAGCAATGGGCAGCCGGAGAACAACTACAAGACCACGCCTCCCGTG<br>CTGGACTCCGACGGCTCCTTCTTCCTCTACAGCAAGCTCACCGTGGACAAGAGCAGG<br>TGGCAGCAGGGGAACGTCTTCTCATGCTCCGTGATGCACGAGGCTCTGCACAACCAC<br>TACACGCAGAAGAGCCTCTCCCTGTCTCCGGGTAAAATCGATCCAAATAAAGGAAGT<br>GGAACCACTTCAGGTACTACCCGTCTTCTATCTGGGCACACGTGTTTCACGTTGACA<br>GGTTTGCTTGGGACGCTAGTAACCATGGGCTTGCTGACTTAG<br>(SEQ ID NO: 233)<br>>Artificial Sequence; hPDL2-Fc-GPI, Amino Acid<br>MIFLLLMLSLELQLHQIAALFTVTVPKELYIIEHGSNVTLECNFDTGSHVNLGAITA<br>SLQKVENDTSPHRERATLLEEQLPLGKASFHIPQVQVRDEGQYQCIIIYGVAWDYKY<br>LTLKVKASYRKINTHILKVPETDEVELTCQATGYPLAEVSWPNVSVPANTSHSRTPE<br>GLYQVTSVLRLKPPPGRNFSCVFWNTHVRELTLASIDLQSQMEPRTHPTIDDKTHTC<br>PPCPAPELLGGPSVFLFPPKPKDTLMISRTPEVTCVVVDVSHEDPEVKFNWYVDGVE<br>VHNAKTKPREEQYNSTYRVVSVLTVLHQDWLNGKEYKCKVSNKALPAPIEKTISKAK<br>GQPREPQVYTLPPSREEMTKNQVSLTCLVKGFYPSDIAVEWESNGQPENNYKTTPPV<br>LDSDGSFFLYSKLTVDKSRWQQGNVFSCSVMHEALHNHYTQKSLSLSPGKID*PNKGS*<br>*GTTSGTTRLLSGHTCFTLTGLLGTLVTMGLLT*<br>(SEQ ID NO: 234) |
| 4F2-h41BBL | >Artificial Sequence; *4F2-41BBL*, DNA<br>*ATGAGCCAGGACACCGAGGTGGATATGAAGGAGGTGGAGCTGAATGAGTTAGAGCCC*<br>*GAGAAGCAGCCGATGAACGCGGCGTCTGGGGCGGCCATGTCCCTGGCGGGAGCCGAG*<br>*AAGAATGGTCTGGTGAAGATCAAGGTGGCGGAAGACGAGGCGGAGGCGGCAGCCGCG*<br>*GCTAAGTTCACGGGCCTGTCCAAGGAGGAGCTGCTGAAGGTGGCAGGCAGCCCCGGC*<br>*TGGGTACGCACCCGCTGGGCACTGCTGCTGCTCTTCTGGCTCGGCTGGCTCGGCATG*<br>*CTTGCTGGTGCCGTGGTCATAATCGTG*GCCTGCCCCTGGGCCGTGTCCGGGGCTCGC<br>GCCTCGCCCGGCTCCGCGGCCAGCCCGAGACTCCGCGAGGGTCCCGAGCTTTCGCCC<br>GACGATCCCGCCGGCCTCTTGGACCTGCGGCAGGGCATGTTTGCGCAGCTGGTGGCC<br>CAAAATGTTCTGCTGATCGATGGCCCCTGAGCTGGTACAGTGACCCAGGCCTGGCA<br>GGCGTGTCCCTGACGGGGGGCCTGAGCTACAAAGAGGACACGAAGGAGCTGGTGGTG<br>GCCAAGGCTGGAGTCTACTATGTCTTCTTTCAACTAGAGCTGCGGCGCGTGGTGGCC<br>GGCGAGGGCTCAGGCTCCGTTTCACTTGCGCTGCACCTGCAGCCACTGCGCTCTGCT<br>GCTGGGGCCGCCGCCCTGGCTTTGACCGTGGACCTGCCACCCGCCTCCTCCGAGGCT<br>CGGAACTCGGCCTTCGGTTTCCAGGGCCGCTTGCTGCACCTGAGTGCCGGCCAGCGC<br>CTGGGCGTCCATCTTCACACTGAGGCCAGGGCACGCCATGCCTGGCAGCTTACCCAG<br>GGCGCCACAGTCTTGGGACTCTTCCGGGTGACCCCCGAAATCCCAGCCGGACTCCCT<br>TCACCGAGGTCGGAATAA<br>(SEQ ID NO: 235)<br>>Artificial Sequence; *4F2-h41BBL*, Amino Acid<br>*MSQDTEVDMKEVELNELEPEKQPMNAASGAAMSLAGAEKNGLVKIKVAEDEAEAAAA*<br>*AKFTGLSKEELLKVAGSPGWVRTRWALLLLFWLGWLGMLAGAVVIIV*ACPWAVSGAR<br>ASPGSAASPRLREGPELSPDDPAGLLDLRQGMFAQLVAQNVLLIDGPLSWYSDPGLA<br>GVSLTGGLSYKEDTKELVVAKAGVYYVFFQLELRRVVAGEGSGSVSLALHLQPLRSA<br>AGAAALALTVDLPPASSEARNSAFGFQGRLLHLSAGQRLGVHLHTEARARHAWQLTQ<br>GATVLGLFRVTPEIPAGLPSPRSE<br>(SEQ ID NO: 236) |
| hPDL1-4Fc-GPI | >Artificial Sequence; hPDL1-4Fc-GPI, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTGAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCCAAGAGAGAGGAGAAGCTT<br>TTCAATGTGACCAGCACACTGAGAATCAACACAACAACTAATGAGATTTTCTACTGC<br>ACTTTTAGGAGATTAGATCCTGAGGAAAACCATACAGCTGAATTGGTCATCCCAGAA<br>CTACCTCTGGCACATCCTCCAAATGAAAGGGAGTCCAAATATGGTCCCCCATGCCCA<br>TCATGCCCAGCACCTGAGTTCCTGGGGGGACCATCAGTCTTCCTGTTCCCCCCAAAA<br>CCCAAGGACACTCTCATGATCTCCCGGACCCCTGAGGTCACGTGCGTGGTGGTGGAC<br>GTGAGCCAGGAAGACCCCGAGGTCCAGTTCAACTGGTACGTGGATGGCGTGGAGGTG<br>CATAATGCCAAGACAAAGCCGCGGGAGGAGCAGTTCAACAGCACGTACCGTGTGGTC<br>AGGGTCCTCACCGTCCTGCACCAGGACTGGCTGAACGGCAAGGAGTACAAGTGCAAG<br>GTCTCCAACAAAGGCCTCCCGTCCTCCATCGAGAAAACCATCTCCAAAGCCAAAGGG<br>CAGCCCCGAGAGCCACAGGTGTACACCCTGCCCCCATCCCAGGAGGAGATGACCAAG<br>AACCAGGTCAGCCTGACCTGCCTGGTCAAAGGCTTCTACCCCAGCGACATCGCCGTG |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | GAGTGGGAGAGCAATGGGCAGCCGGAGGACAACTACAAGACCACGCCTCCCGTGCTG<br>GACTCCGACGGCTCCTTCTTCCTCTACAGCAGGCTAACCGTGGACAAGAGCAGGTGG<br>CAGGAGGGGAATGTCTTCTCATGCTCCGTGATGCATGAGGCTCTGCACAACCACTAC<br>ACACAGAAGAGCCTCTCCCTGTCTCCGGGTAAACCAAATAAAGGAAGTGGAACCACT<br>TCAGGTACTACCCGTCTTCTATCTGGGCACACGTGTTTCACGTTGACAGGTTTGCTT<br>GGGACGCTAGTAACCATGGGCTTGCTGACTTAG<br>(SEQ ID NO: 237)<br>>Artificial Sequence; hPDL1-4Fc-GPI, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPE<br>LPLAHPPNERESKYGPPCPSCPAPEFLGGPSVFLFPPKPKDTLMISRTPEVTCVVVD<br>VSQEDPEVQFNWYVDGVEVHNAKTKPREEQFNSTYRVVRVLTVLHQDWLNGKEYKCK<br>VSNKGLPSSIEKTISKAKGQPREPQVYTLPPSQEEMTKNQVSLTCLVKGFYPSDIAV<br>EWESNGQPEDNYKTTPPVLDSDGSFFLYSRLTVDKSRWQEGNVFSCSVMHEALHNHY<br>TQKSLSLSPGKPNKGSGTTSGTTRLLSGHTCFTLTGLLGTLVTMGLLT<br>(SEQ ID NO: 238) |
| hPDL1-GPI-P2A-<br>hFGL1-GPI | >Artificial Sequence; hPDL1-GPI-P2A-hFGL1-GPI, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTGAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCCAAGAGAGAGGAGAAGCTT<br>TTCAATGTGACCAGCACACTGAGAATCAACACAACAACTAATGAGATTTTCTACTGC<br>ACTTTTAGGAGATTAGATCCTGAGGAAAACCATACAGCTGAATTGGTCATCCCAGAA<br>CTACCTCTGGCACATCCTCCAAATGAAAGGCCAAATAAAGGAAGTGGAACCACTTCA<br>GGTACTACCCGTCTTCTATCTGGGCACACGTGTTTCACGTTGACAGGTTTGCTTGGG<br>ACGCTAGTAACCATGGGCTTGCTGACTGAAGCGGAGCTACTAACTTCAGCCTGCTG<br>AAGCAGGCTGGCGACGTGGAGGAGAACCCTGGACCTATGGCAAAGGTGTTCAGTTTC<br>ATCCTTGTTACCACCGCTCTGACAATGGGCAGGGAAATTTCGGCGCTCGAGGACTGT<br>GCCCAGGAGCAGATGCGGCTCAGAGCCCAGGTGCGCCTGCTTGAGACCCGGGTCAAA<br>CAGCAACAGGTCAAGATCAAGCAGCTTTTGCAGGAGAATGAAGTCCAGTTCCTTGAT<br>AAAGGAGATGAGAATACTGTCATTGATCTTGGAAGCAAGAGGCAGTATGCAGATTGT<br>TCAGAGATTTTCAATGATGGGTATAAGCTCAGTGGATTTTACAAAATCAAACCTCTC<br>CAGAGCCCAGCAGAATTTTCTGTTTATTGTGACATGTCCGATGGAGGAGGATGGACT<br>GTAATTCAGAGACGATCTGATGGCAGTGAAAACTTTAACAGAGGATGGAAAGACTAT<br>GAAAATGGCTTTGGAAATTTTGTCCAAAAACATGGTGAATATTGGCTGGGCAATAAA<br>AATCTTCACTTCTTGACCACTCAAGAAGACTACACTTTAAAAATCGACCTTGCAGAT<br>TTTGAAAAAAATAGCCGTTATGCACAATATAAGAATTTCAAAGTTGGAGATGAAAAG<br>AATTTCTACGAGTTGAATATTGGGGAATATTCTGGAACAGCTGGAGATTCCCTTGCG<br>GGGAATTTTCATCCTGAGGTGCAGTGGTGGGCTAGTCACCAAAGAATGAAATTCAGC<br>ACGTGGGACAGAGATCATGACAACTATGAAGGGAACTGCGCAGAAGAAGATCAGTCT<br>GGCTGGTGGTTTAACAGGTGTCACTCTGCAAACCTGAATGGTGTATACTACAGCGGC<br>CCCTACACGGCTAAAACAGACAATGGGATTGTCTGGTACACCTGGCATGGGTGGTGG<br>TATTCTCTGAAATCTGTGGTTATGAAAATTAGGCCAAATGATTTTATTCCAAATGTA<br>ATTCCAAATAAAGGAAGTGGAACCACTTCAGGTACTACCCGTCTTCTATCTGGGCAC<br>ACGTGTTTCACGTTGACAGGTTTGCTTGGGACGCTAGTAACCATGGGCTTGCTGACT<br>TAG<br>(SEQ ID NO: 239)<br>>Artificial Sequence; hPDL1-GPI-P2A-hFGL1-GPI, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPE<br>LPLAHPPNERPNKGSGTTSGTTRLLSGHTCFTLTGLLGTLVTMGLLTGSGATNFSLL<br>KQAGDVEENPGPMAKVFSFILVTTALTMGREISALEDCAQEQMRLRAQVRLLETRVK<br>QQQVKIKQLLQENEVQFLDKGDENTVIDLGSKRQYADCSEIFNDGYKLSGFYKIKPL<br>QSPAEFSVYCDMSDGGGWTVIQRRSDGSENFNRGWKDYENGFGNFVQKHGEYWLGNK<br>NLHFLTTQEDYTLKIDLADFEKNSRYAQYKNFKVGDEKNFYELNIGEYSGTAGDSLA<br>GNFHPEVQWWASHQRMKFSTWDRDHDNYEGNCAEEDQSGWWFNRCHSANLNGVYYSG<br>PYTAKTDNGIVWYTWHGWWYSLKSVVMKIRPNDFIPNVIPNKGSGTTSGTTRLLSGH<br>TCFTLTGLLGTLVTMGLLT<br>(SEQ ID NO: 240) |
| Myr-mScarlet | >Artificial Sequence; Myr-mScarlet, DNA<br>ATGGGTTGCTGTTTCTCCAAGACCGGCTCGAGCGGCGTGAGCAAGGGCGAGGCAGTG<br>ATCAAGGAGTTCATGCGGTTCAAGGTGCACATGGAGGGCTCCATGAACGGCCACGAG<br>TTCGAGATCGAGGGCGAGGGCGAGGGCCGCCCCTACGAGGGCACCCAGACCGCCAAG |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | CTGAAGGTGACCAAGGGTGGCCCCCTGCCCTTCTCCTGGGACATCCTGTCCCCTCAG<br>TTCATGTACGGCTCCAGGGCCTTCACCAAGCACCCCGCCGACATCCCCGACTACTAT<br>AAGCAGTCCTTCCCCGAGGGCTTCAAGTGGGAGCGCGTGATGAACTTCGAGGACGGC<br>GGCGCCGTGACCGTGACCCAGGACACCTCCCTGGAGGACGGCACCCTGATCTACAAG<br>GTGAAGCTCCGCGGCACCAACTTCCCTCCTGACGGCCCCGTAATGCAGAAGAAGACA<br>ATGGGCTGGGAAGCGTCCACCGAGCGGTTGTACCCCGAGGACGGCGTGCTGAAGGGC<br>GACATTAAGATGGCCCTGCGCCTGAAGGACGGCGGCCGCTACCTGGCGGACTTCAAG<br>ACCACCTACAAGGCCAAGAAGCCCGTGCAGATGCCCGGCGCCTACAACGTCGACCGC<br>AAGTTGGACATCACCTCCCACAACGAGGACTACACCGTGGTGGAACAGTACGAACGC<br>TCCGAGGGCCGCCACTCCACCGGCGGCATGGACGAGCTGTACAAG<br>(SEQ ID NO: 241)<br>>Artificial Sequence; *Myr*-mScarlet, Amino Acid<br>*MGCCFSKT*GSSGVSKGEAVIKEFMRFKVHMEGSMNGHEFEIEGEGEGRPYEGTQTAK<br>LKVTKGGPLPFSWDILSPQFMYGSRAFTKHPADIPDYYKQSFPEGFKWERVMNFEDG<br>GAVTVTQDTSLEDGTLIYKVKLRGTNFPPDGPVMQKKTMGWEASTERLYPEDGVLKG<br>DIKMALRLKDGGRYLADFKTTYKAKKPVQMPGAYNVDRKLDITSHNEDYTVVEQYER<br>SEGRHSTGGMDELYK<br>(SEQ ID NO: 242) |
| Myr-NanoLuc<br>Luciferase | > Artificial Sequence; *Myr*-NanoLuc, DNA<br>*ATGGGTTGCTGTTTCTCCAAGACC*GGCTCGAGCGGCGTCTTCACACTCGAAGATTTC<br>GTTGGGGACTGGCGACAGACAGCCGGCTACAACCTGGACCAAGTCCTTGAACAGGGA<br>GGTGTGTCCAGTTTGTTTCAGAATCTCGGGGTGTCCGTAACTCCGATCCAAAGGATT<br>GTCCTGAGCGGTGAAAATGGGCTGAAGATCGACATCCATGTCATCATCCCGTATGAA<br>GGTCTGAGCGGCGACCAAATGGGCCAGATCGAAAAAATTTTTAAGGTGGTGTACCCT<br>GTGGATGATCATCACTTTAAGGTGATCCTGCACTATGGCACACTGGTAATCGACGGG<br>GTTACGCCGAACATGATCGACTATTTCGGACGGCCGTATGAAGGCATCGCCGTGTTC<br>GACGGCAAAAAGATCACTGTAACAGGGACCCTGTGGAACGGCAACAAAATTATCGAC<br>GAGCGCCTGATCAACCCCGACGGCTCCCTGCTGTTCCGAGTAACCATCAACGGAGTG<br>ACCGGCTGGCGGCTGTGCGAACGCATTCTGGCGTAA<br>(SEQ ID NO: 243)<br>>Artificial Sequence; *Myr*-NanoLuc, Amino Acid<br>*MGCCFSKT*GSSGVFTLEDFVGDWRQTAGYNLDQVLEQGGVSSLFQNLGVSVTPIQRI<br>VLSGENGLKIDIHVIIPYEGLSGDQMGQIEKIFKVVYPVDDHHFKVILHYGTLVIDG<br>VTPNMIDYFGRPYEGIAVFDGKKITVTGTLWNGNKIIDERLINPDGSLLFRVTINGV<br>TGWRLCERILA<br>(SEQ ID NO: 244) |
| hSecPDL1-GPI | >Artificial Sequence; hSecPDL1-*GPI*, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCCAAGAGAGAGGAGAAGCTT<br>TTCAATGTGACCAGCACACTGAGAATCAACACAACAACTAATGAGATTTTCTACTGC<br>ACTTTTAGGAGATTAGATCCTGAGGAAAACCATACAGCTGAATTGGTCATCCCAGGT<br>AATATTCTGAATGTGTCCATTAAAATATGTCTAACACTGTCCCCTAGCACC*CCAAAT<br>AAAGGAAGTGGAACCACTTCAGGTACTACCCGTCTTCTATCTGGGCACACGTGTTTC<br>ACGTTGACAGGTTTGCTTGGGACGCTAGTAACCATGGGCTTGCTGACTTAG*<br>(SEQ ID NO: 245)<br>>Artificial Sequence; hSecPDL1-*GPI*, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPG<br>NILNVSIKICLTLSPST*PNKGSGTTSGTTRLLSGHTCFTLTGLLGTLVTMGLLT*<br>(SEQ ID NO: 246) |
| Tfr2-h41BBL | >Artificial Sequence; *Tfr2*-h41BBL, DNA<br>ATGGAGCGGCTTTGGGGTCTATTCCAGAGAGCGCAACAACTGTCCCCAAGATCCTCT<br>CAGACCGTCTACCAGCGTGTGGAAGGCCCCCGGAAAGGGCACCTGGAGGAGGAAGAG<br>GAAGACGGGGAGGAGGGGCGGAGACATTGGCCCACTTCTGCCCCATGGAGCTGAGG<br>GGCCCTGAGCCCCTGGGCTCTAGACCCAGGCAGCCAAACCTCATTCCCTGGGCGGCA<br>GCAGGACGGAGGGCTGCCCCCTACCTGGTCCTGACGGCCCTGCTGATCTTCACTGGG<br>GCCTTCCTACTGGGCTACGTCGCCTTCCAGGGTCCGCCTGCCCCTGGGCCGTGTCC<br>GGGGCTCGCGCCTCGCCCGGCTCCGCGGCCAGCCCGAGACTCCGCGAGGGTCCCGAG<br>CTTTCGCCCGACGATCCCGCCGGCCTCTTGGACCTGCGGCAGGGCATGTTTGCGCAG<br>CTGGTGGCCCAAAATGTTCTGCTGATCGATGGGCCCCTGAGCTGGTACAGTGACCCA<br>GGCCTGGCAGGCGTGTCCCTGACGGGGGGCTGAGCTACAAAGAGGACACGAAGGAG<br>CTGGTGGTGGCCAAGGCTGGAGTCTACTATGTCTTCTTTCAACTAGAGCTGCGGCGC

TABLE 4-continued

Full Length Constructs

| Fusion Polypeptide | Nucleic Acid Sequence (SEQ ID NO:)<br>Amino Acid Sequence (SEQ ID NO:) |
|---|---|
| | *GTGGTGGCCGGCGAGGGCTCAGGCTCCGTTTCACTTGCGCTGCACCTGCAGCCACTG*<br>*CGCTCTGCTGCTGGGGCCGCCGCCCTGGCTTTGACCGTGGACCTGCCACCCGCCTCC*<br>*TCCGAGGCTCGGAACTCGGCCTTCGGTTTTCAGGGCCGCTTGCTGCACCTGAGTGCC*<br>*GGCCAGCGCCTGGGCGTCCATCTTCACACTGAGGCCAGGGCACGCCATGCCTGGCAG*<br>*CTTACCCAGGGCGCCACAGTCTTGGGACTCTTCCGGGTGACCCCCGAAATCCCAGCC*<br>*GGACTCCCTTCACCGAGGTCGGAATAA*<br>(SEQ ID NO: 247)<br>>Artificial Sequence; *Tfr2*-h41BBL, Amino Acid<br>MERLWGLFQRAQQLSPRSSQTVYQRVEGPRKGHLEEEEEDGEEGAETLAHFCPMELR<br>GPEPLGSRPRQPNLIPWAAAGRRAAPYLVLTALLIFTGAFLLGYVAFRGSACPWAVS<br>GARASPGSAASPRLRGPELSPDDPAGLLDLRQGMFAQLVAQNVLLIDGPLSWYSDPG<br>LAGVSLTGGLSYKEDTKELVVAKAGVYYVFFQLELRRVVAGEGSGSVSLALHLQPLR<br>SAAGAAALALTVDLPPASSEARNSAFGFQGRLLHLSAGQRLGVHLHTEARARHAWQL<br>TQGATVLGLFRVTPEIPAGLPSPRSE<br>(SEQ ID NO: 248) |
| CD9tm3-h41BBL | >Artificial Sequence; *CD9tm3*-h41BBL, DNA<br>ATGGGCTGCTGCGGGCTGTGCAGGAGTCCCAGTGCATGCTGGGACTGTTCTTCGGC<br>TTCCTCTTGGTGATATTCGCCATTGAAATAGCTGCGGCCATCTGGGGATATTCCCAC<br>AAGGATGAGGCCTGCCCCTGGGCCGTGTCCGGGGCTCGCGCCTCGCCCGGCTCCGCG<br>GCCAGCCCGAGACTCCGCGAGGGTCCCGAGCTTTCGCCCGACGATCCCGCCGGCCTC<br>TTGGACCTGCGGCAGGGCATGTTTGCGCAGCTGGTGGCCCAAAATGTTCTGCTGATC<br>GATGGGCCCCTGAGCTGGTACAGTGACCCAGGCCTGGCAGGCGTGTCCCTGACGGGG<br>GGCCTGAGCTACAAAGAGGACACGAAGGAGCTGGTGGTGGCCAAGGCTGGAGTCTAC<br>TATGTCTTCTTTCAACTAGAGCTGCGGCGCGTGGTGGCCGGCGAGGGCTCAGGCTCC<br>GTTTCACTTGCGCTGCACCTGCAGCCACTGCGCTCTGCTGCTGGGGCCGCCGCCCTG<br>GCTTTGACCGTGGACCTGCCACCCGCCTCCTCCGAGGCTCGGAACTCGGCCTTCGGT<br>TTCCAGGGCCGCTTGCTGCACCTGAGTGCCGGCCAGCGCCTGGGCGTCCATCTTCAC<br>ACTGAGGCCAGGGCACGCCATGCCTGGCAGCTTACCCAGGGCGCCACAGTCTTGGGA<br>CTCTTCCGGGTGACCCCCGAAATCCCAGCCGGACTCCCTTCACCGAGGTCGGAATAA<br>(SEQ ID NO: 249)<br>>Artificial Sequence; *CD9tm3*-h41BBL, Amino Acid<br>MGCCGAVQESQCMLGLFFGFLLVIFAIEIAAAIWGYSHKDEACPWAVSGARASPGSA<br>ASPRLREGPELSPDDPAGLLDLRQGMFAQLVAQNVLLIDGPLSWYSDPGLAGVSLTG<br>GLSYKEDTKELVVAKAGVYYVFFQLELRRVVAGEGSGSVSLALHLQPLRSAAGAAAL<br>ALTVDLPPASSEARNSAFGFQGRLLHLSAGQRLGVHLHTEARARHAWQLTQGATVLG<br>LFRVTPEIPAGLPSPRSE<br>(SEQ ID NO: 250) |
| Myr/Palm-4F2-<br>h41BBL | >Artificial Sequence; *Myr/Palm*-4F2-h41BBL, DNA<br><u>ATGGGTTGCTGTTTCTCCAAGAC</u>CGGCTCGAGCGGCAGCCAGGACACCGAGGTGGAT<br>ATGAAGGAGGTGGAGCTGAATGAGTTAGAGCCCGAGAAGCAGCCGATGAACGCGGCG<br>TCTGGGGCGGCCATGTCCCTGGCGGGAGCCGAGAAGAATGGTCTGGTGAAGATCAAG<br>GTGGCGGAAGACGAGGCGGAGGCGGCAGCCGCGGCTAAGTTCACGGGCCTGTCCAAG<br>GAGGAGCTGCTGAAGGTGGCAGGCAGCCCCGGCTGGGTACGCACCCGCTGGGCACTG<br>CTGCTGCTCTTCTGGCTCGGCTGGCTCGGCATGCTTGCTGGTGCCGTGGTCATAATC<br>GTGGCCTGCCCCTGGGCCGTGTCCGGGGCTCGCGCCTCGCCCGGCTCCGCGGCCAGC<br>CCGAGACTCCGCGAGGGTCCCGAGCTTTCGCCCGACGATCCCGCCGGCCTCTTGGAC<br>CTGCGGCAGGGCATGTTTGCGCAGCTGGTGGCCCAAAATGTTCTGCTGATCGATGGG<br>CCCCTGAGCTGGTACAGTGACCCAGGCCTGGCAGGCGTGTCCCTGACGGGGGGCCTG<br>AGCTACAAAGAGGACACGAAGGAGCTGGTGGTGGCCAAGGCTGGAGTCTACTATGTC<br>TTCTTTCAACTAGAGCTGCGGCGCGTGGTGGCCGGCGAGGGCTCAGGCTCCGTTTCA<br>CTTGCGCTGCACCTGCAGCCACTGCGCTCTGCTGCTGGGGCCGCCGCCCTGGCTTTG<br>ACCGTGGACCTGCCACCCGCCTCCTCCGAGGCTCGGAACTCGGCCTTCGGTTTCCAG<br>GGCCGCTTGCTGCACCTGAGTGCCGGCCAGCGCCTGGGCGTCCATCTTCACACTGAG<br>GCCAGGGCACGCCATGCCTGGCAGCTTACCCAGGGCGCCACAGTCTTGGGACTCTTC<br>CGGGTGACCCCCGAAATCCCAGCCGGACTCCCTTCACCGAGGTCGGAATAA<br>(SEQ ID NO: 251)<br>>Artificial Sequence; *Myr/Palm*-4F2-h41BBL, Amino Acid<br><u>MGCCFSKTGSSGSQDTEVDMKEVELNELEPEKQPMNAASGAAMSLAGAEKNGLVKIK</u><br><u>VAEDEAEAAAAAKFTGLSKEELLKVAGSPGWVRTRWALLLLFWLGWLGMLAGAVVII</u><br><u>V</u>ACPWAVSGARASPGSAASPRLREGPELSPDDPAGLLDLRQGMFAQLVAQNVLLIDG<br>PLSWYSDPGLAGVSLTGGLSYKEDTKELVVAKAGVYYVFFQLELRRVVAGEGSGSVS<br>LALHLQPLRSAAGAAALALTVDLPPASSEARNSAFGFQGRLLHLSAGQRLGVHLHTE<br>ARARHAWQLTQGATVLGLFRVTPEIPAGLPSPRSE<br>(SEQ ID NO: 252) |
| Myr/Palm-Link-<br>41BBL (41BBL<br>transmembrane<br>domain<br>included) | >Artificial Sequence; *Myr/Palm*-Link-41BBL, DNA<br><u>ATGGGTTGCTGTTTCTCCAAGAC</u>CGGCTCGAGCGGCTGGGCCCTGGTCGCGGGGCTG<br>CTGCTGCTGCTGCTCGCTGCCGCCTGCGCCGTCTTCCTCGCCTGCCCCTGGGCC<br>GTGTCCGGGGCTCGCGCCTCGCCCGGCTCCGCGGCCAGCCCGAGACTCCGCGAGGGT<br>CCCGAGCTTTCGCCCGACGATCCCGCCGGCCTCTTGGACCTGCGGCAGGGCATGTTT<br>GCGCAGCTGGTGGCCCAAAATGTTCTGCTGATCGATGGGCCCCTGAGCTGGTACAGT<br>GACCCAGGCCTGGCAGGCGTGTCCCTGACGGGGGGCCTGAGCTACAAAGAGGACACG<br>AAGGAGCTGGTGGTGGCCAAGGCTGGAGTCTACTATGTCTTCTTTCAACTAGAGCTG |

TABLE 4-continued

Full Length Constructs

| Fusion Polypeptide | Nucleic Acid Sequence (SEQ ID NO:) Amino Acid Sequence (SEQ ID NO:) |
|---|---|
| | CGGCGCGTGGTGGCCGGCGAGGGCTCAGGCTCCGTTTCACTTGCGCTGCACCTGCAG<br>CCACTGCGCTCTGCTGCTGGGGCCGCCGCCCTGGCTTTGACCGTGGACCTGCCACCC<br>GCCTCCTCCGAGGCTCGGAACTCGGCCTTCGGTTTCCAGGGCCGCTTGCTGCACCTG<br>AGTGCCGGCCAGCGCCTGGGCGTCCATCTTCACACTGAGGCCAGGGCACGCCATGCC<br>TGGCAGCTTACCCAGGGCGCCACAGTCTTGGGACTCTTCCGGGTGACCCCCGAAATC<br>CCAGCCGGACTCCCTTCACCGAGGTCGGAATAA<br>(SEQ ID NO: 253)<br>>Artificial Sequence; *Myr/Palm*-Link-41BBL, Amino Acid<br><u>*MGCCFSKT*</u>GSSGWALVAGLLLLLLLAAACAVFLACPWAVSGARASPGSAASPRLREG<br>PELSPDDPAGLLDLRQGMFAQLVAQNVLLIDGPLSWYSDPGLAGVSLTGGLSYKEDT<br>KELVVAKAGVYYVFFQLELRRVVAGEGSGSVSLALHLQPLRSAAGAAALALTVDLPP<br>ASSEARNSAFGFQGRLLHLSAGQRLGVHLHTEARARHAWQLTQGATVLGLFRVTPEI<br>PAGLPSPRSE<br>(SEQ ID NO: 254) |
| hPDL1-Link-GPI | >Artificial Sequence; hPDL1-<u>Link</u>-*GPI*, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCCAAGAGAGGAGAAGCTT<br>TTCAAGTGACCAGCACACTGAGAATCAACACAACAACTAATGAGATTTTCTACTGC<br>ACTTTTAGGAGATTAGATCCTGAGGAAAACCATACAGCTGAATT<u>GGGCTCGAGCGGC</u><br>*CCAAATAAAGGAAGTGGAACCACTTCAGGTACTACCCGTCTTCTATCTGGGCACACG*<br>*TGTTTCACGTTGACAGGTTTGCTTGGGACGCTAGTAACCATGGGCTTGCTGACTTAG*<br>(SEQ ID NO: 255)<br>>Artificial Sequence; hPDL1-<u>Link</u>-*GPI*, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAEL<u>GSSG</u><br>*PNKGSGTTSGTTRLLSGHTCFTLTGLLGTLVTMGLLT*<br>(SEQ ID NO: 256) |
| hSecPDL1-<br>CD9tm2 | >Artificial Sequence; hSecPDL1-*CD9tm2*, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCCAAGAGAGGAGAAGCTT<br>TTCAATGTGACCAGCACACTGAGAATCAACACAACAACTAATGAGATTTTCTACTGC<br>ACTTTTAGGAGATTAGATCCTGAGGAAAACCATACAGCTGAATTGGTCATCCCAGGT<br>AATATTCTGAATGTGTCCATTAAAATATGTCTAACACTGTCTCCCTAGCACC*TTCTAC*<br>*ACAGGAGTCTATATTCTGATCGGAGCCGGCGCCCTCATGATGCTGGTGGGCTTCCTG*<br>*GGCTGCTGCGGGGCTGTGCAGGAGTCCCAGTGCTAG*<br>(SEQ ID NO: 257)<br>>Artificial Sequence; hSecPDL1-*CD9tm2*, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPG<br>NILNVSIKICLTLSPST*FYTGVYILIGAGALMMLVGFLGCCGAVQESQC*<br>(SEQ ID NO: 258) |
| hSecPDL1-<br>CD9tm2-<br>modified KRAS | >Artificial Sequence; hSecPDL1-*CD9tm2*-<u>KRAS</u>, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCCAAGAGAGAGGAGAAGCTT |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | TTCAATGTGACCAGCACACTGAGAATCAACACAACAACTAATGAGATTTTCTACTGC<br>ACTTTTAGGAGATTAGATCCTGAGGAAAACCATACAGCTGAATTGGTCATCCCAGGT<br>AATATTCTGAATGTGTCCATTAAAATATGTCTAACACTGTCCCCTAGCACC*TTCTAC<br>ACAGGAGTCTATATTCTGATCGGAGCCGGCGCCCTCATGATGCTGGTGGGCTTCCTG<br>GGCTGCTGCGGGGCTGTGCAGGAGTCCCAGTGCAAAAAGAAGAAAAAGAAGTCAAAG<br>ACAAAGTGTGTAATTATGTAA*<br>(SEQ ID NO: 259)<br>>Artificial Sequence; hSecPDL1-*CD9tm2-KRAS*, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPG<br>NILNVSIKICLTLSPST*FYTGVYILIGAGALMMLVGFLGCCGAVQESQCKKKKKKSK<br>TKCVIM*<br>(SEQ ID NO: 260) |
| hSecPDL1-<br>CD9tm4 | >Artificial Sequence; hSecPDL1-*CD9tm4*, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCCAAGAGAGGAGAAGCTT<br>TTCAATGTGACCAGCACACTGAGAATCAACACAACAACTAATGAGATTTTCTACTGC<br>ACTTTTAGGAGATTAGATCCTGAGGAAAACCATACAGCTGAATTGGTCATCCCAGGT<br>AATATTCTGAATGTGTCCATTAAAATATGTCTAACACTGTCCCCTAGCACC*ATCGGC<br>GCAGTGGGCATCGGCATTGCCGTGGTCATGATATTTGGCATGATCTTCAGTATGATC<br>TTGTGCTGTGCTATCCGCAGGAACCGCGAGATGGTCTAG*<br>(SEQ ID NO: 261)<br>>Artificial Sequence; hSecPDL1-*CD9tm4*, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTIAINTTTNEIFYCTFRRLDPEENHTAELVIPG<br>NILNVSIKICLTLSPST*IGAVGIGIAVVMIFGMIFSMILCCAIRRNREMV*<br>(SEQ ID NO: 262) |
| hSecPDL1-CD81 | >Artificial Sequence; hSecPDL1-*CD81*, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCCAAGAGAGGAGAAGCTT<br>TTCAATGTGACCAGCACACTGAGAATCAACACAACAACTAATGAGATTTTCTACTGC<br>ACTTTTAGGAGATTAGATCCTGAGGAAAACCATACAGCTGAATTGGTCATCCCAGGT<br>AATATTCTGAATGTGTCCATTAAAATATGTCTAACACTGTCCCCTAGCACC*CTGTAC<br>CTCATCGGCATTGCTGCCATCGTGGTCGCTGTGATCATGATCTTCGAGATGATCCTG<br>AGCATGGTGCTGTGCTGTGGCATCCGGAACAGCTCCGTGTACTGA*<br>(SEQ ID NO: 263)<br>>Artificial Sequence; hSecPDL1-*CD81*, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPG<br>NILNVSIKICLTLSPST*LYLIGIAAIVVAVIMIFEMILSMVLCCGIRNSSVY*<br>(SEQ ID NO: 264) |
| hCD200-Fc-GPI | >Artificial Sequence; hCD200-*Fc-GPI*, DNA<br>ATGGAGAGGCTGGTGATCAGGATGCCCTTCTCTCATCTGTCTACCTACAGCCTGGTT<br>TGGGTCATGGCAGCAGTGGTGCTGTGCACAGCACAAGTGCAAGTGGTGACCCAGGAT<br>GAAAAGAGAGCAGCTGTACACACCTGCTTCCTTAAAATGCTCTCTGCCAAAATGCCCAG<br>GAAGCCCTCATTGTGACATGGCAGAAAAGAAAGCTGTAAGCCCAGAAAACATGGTC<br>ACCTTCAGCGAGAACCATGGGGTGGTGATCCAGCCTGCCTATAAGGACAAGATAAAC<br>ATTACCCAGCTGGGACTCCAAAACTCAACCATCACCTTCTGGAATATCACCCTGGAG<br>GATGAAGGGTGTTACATGTGTCTCTTCAATACCTTTGGTTTTGGGAAGATCTCAGGA<br>ACGGCCTGCCTCACCGTCTATGTACAGCCCATAGTATCCCTTCACTACAAATTCTCT |

TABLE 4-continued

Full Length Constructs

| Fusion Polypeptide | Nucleic Acid Sequence (SEQ ID NO:) Amino Acid Sequence (SEQ ID NO:) |
|---|---|
| | GAAGACCACCTAAATATCACTTGCTCTGCCACTGCCCGCCCAGCCCCCATGGTCTTC<br>TGGAAGGTCCCTCGGTCAGGGATTGAAAATAGTACAGTGACTCTGTCTCACCCAAAT<br>GGGACCACGTCTGTTACCAGCATCCTCCATATCAAAGACCCTAAGAATCAGGTGGGG<br>AAGGAGGTGATCTGCCAGGTGCTGCACCTGGGGACTGTGACCGACTTTAAGCAAACC<br>GTCAACAAAGGCATCGAT*GACAAAACTCACACATGCCCACCGTGCCCAGCACCTGAA<br>CTCCTGGGGGGACCGTCAGTCTTCCTCTTCCCCCCAAAACCCAAGGACACCCTCATG<br>ATCTCCCGGACCCCTGAGGTCACATGCGTGGTGGTGGACGTGAGCCACGAAGACCCT<br>GAGGTCAAGTTCAACTGGTACGTGGACGGCGTGGAGGTGCATAATGCCAAGACAAAG<br>CCGCGGGAGGAGCAGTACAACAGCACGTACCGTGTGGTCAGCGTCCTCACCGTCCTG<br>CACCAGGACTGGCTGAATGGCAAGGAGTACAAGTGCAAGGTCTCCAACAAAGCCCTC<br>CCAGCCCCCATCGAGAAAACCATCTCCAAAGCCAAAGGGCAGCCCCGAGAACCACAG<br>GTGTACACCCTGCCCCCATCCCGGGAGGAGATGACCAAGAACCAGGTCAGCCTGACC<br>TGCCTGGTCAAAGGCTTCTATCCCAGCGACATCGCCGTGGAGTGGGAGAGCAATGGG<br>CAGCCGGAGAACAACTACAAGACCACGCCTCCCGTGCTGGACTCCGACGGCTCCTTC<br>TTCCTCTACAGCAAGCTCACCGTGGACAAGAGCAGGTGGCAGCAGGGGAACGTCTTC<br>TCATGCTCCGTGATGCACGAGGCTCTGCACAACCACTACACGCAGAAGAGCCTCTCC<br>CTGTCTCCGGGTAAAATCGAT*CCAAATAAAGGAAGTGGAACCACTTCAGGTACTACC<br>CGTCTTCTATCTGGGCACACGTGTTTCACGTTGACAGGTTTGCTTGGGACGCTAGTA<br>ACCATGGGCTTGCTGACTTAG<br>(SEQ ID NO: 265)<br>>Artificial Sequence; hCD200-Fc-GPI, Amino Acid<br>MERLVIRMPFSHLSTYSLVWVMAAVVLCTAQVQVVTQDEREQLYTPASLKCSLQNAQ<br>EALIVTWQKKKAVSPENMVTFSENHGVVIQPAYKDKINITQLGLQNSTITFWNITLE<br>DEGCYMCLFNTFGFGKISGTACLTVYVQPIVSLHYKFSEDHLNITCSATARPAPMVF<br>WKVPRSGIENSTVTLSHPNGTTSVTSILHIKDPKNQVGKEVICQVLHLGTVTDFKQT<br>VNKGI*DDKTHTCPPCPAPELLGGPSVFLFPPKPKDTLMISRTPEVTCVVVDVSHEDP<br>EVKFNWYVDGVEVHNAKTKPREEQYNSTYRVVSVLTVLHQDWLNGKEYKCKVSNKAL<br>PAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLS<br>LSPGKID*PNKGSGTTSGTTRLLSGHTCFTLTGLLGTLVTMGLLT*<br>(SEQ ID NO: 266) |
| hFGL1-GPI | >Artificial Sequence; hFGL1-GPI, DNA<br>ATGGCAAAGGTGTTCAGTTTCATCCTTGTTACCACCGCTCTGACAATGGGCAGGGAA<br>ATTTCGGCGCTCGAGGACTGTGCCCAGGAGCAGATGCGGCTCAGAGCCCAGGTGCGC<br>CTGCTTGAGACCCGGGTCAAACAGCAACAGGTCAAGATCAAGCAGCTTTTGCAGGAG<br>AATGAAGTCCAGTTCCTTGATAAAGGAGATGAGAATACTGTCATTGATCTTGGAAGC<br>AAGAGGCAGTATGCAGATTGTTCAGAGATTTTCAATGATGGGTATAAGCTCAGTGGA<br>TTTTACAAAATCAAACCTCTCCAGAGCCCAGCAGAATTTTCTGTTTATTGTGACATG<br>TCCGATGGAGGAGGATGGACTGTAATTCAGAGACGATCTGATGGCAGTGAAAACTTT<br>AACAGAGGATGGAAGACTATGAAAATGGCTTTGGAAATTTTGTCCAAAAACATGGT<br>GAATATTGGCTGGGCAATAAAAATCTTCACTTCTTGACCACTCAAGAAGACTACACT<br>TTAAAAATCGACCTTGCAGATTTTGAAAAAAATAGCCGTTATGCACAATATAAGAAT<br>TTCAAAGTTGGAGATGAAAAGAATTTCTACGAGTTGAATATTGGGGAATATTCTGGA<br>ACAGCTGGAGATTCCCTTGCGGGGAATTTTCATCCTGAGGTGCAGTGGTGGGCTAGT<br>CACCAAAGAATGAAATTCAGCACGTGGGACAGAGATCATGACAACTATGAAGGGAAC<br>TGCGCAGAAGAAGATCAGTCGGCTGGTGGTTTAACAGGTGTCACTCTGCAAACCTG<br>AATGGTGTATACTACAGCGGCCCCTACACGGCTAAAACAGACAATGGGATTGTCTGG<br>TACACCTGGCATGGGTGGTGGTATTCTCTGAAATCTGTGGTTATGAAAATTAGGCCA<br>AATGATTTTATTCCAAATGTAATT*CCAAATAAAGGAAGTGGAACCACTTCAGGTACT<br>ACCCGTCTTCTATCTGGGCACACGTGTTTCACGTTGACAGGTTTGCTTGGGACGCTA<br>GTAACCATGGGCTTGCTGACTTAG*<br>(SEQ ID NO: 267)<br>>Artificial Sequence; hFGL1-GPI, Amino Acid<br>MAKVFSFILVTTALTMGREISALEDCAQEQMRLRAQVRLLETRVKQQQVKIKQLLQE<br>NEVQFLDKGDENTVIDLGSKRQYADCSEIFNDGYKLSGFYKIKPLQSPAEFSVYCDM<br>SDGGGWTVIQRRSDGSENFNRGWKDYENGFGNFVQKHGEYWLGNKNLHFLTTQEDYT<br>LKIDLADFEKNSRYAQYKNFKVGDEKNFYELNIGEYSGTAGDSLAGNFHPEVQWWAS<br>HQRMKFSTWDRDHDNYEGNCAEEDQSGWWFNRCHSANLNGVYYSGPYTAKTDNGIVW<br>YTWHGWWYSLKSVVMKIRPNDFIPNVI*PNKGSGTTSGTTRLLSGHTCFTLTGLLGTL<br>VTMGLLT*<br>(SEQ ID NO: 268) |
| hGal9-Fc-GPI | >Artificial Sequence; hGal9-Fc-GPI, DNA<br>ATGGCCTTCAGCGGTTCCCAGGCTCCCTACCTGAGTCCAGCTGTCCCCTTTTCTGGG<br>ACTATTCAAGGAGGTCTCCAGGACGGACTTCAGATCACTGTCAATGGGACCGTTCTC<br>AGCTCCAGTGGAACCAGGTTTGCTGTGAACTTTCAGACTGGCTTCAGTGGAAATGAC<br>ATTGCCTTCCACTTCAACCCTCGGTTTGAAGATGGAGGGTACGTGGTGTGCAACACG<br>AGGCAGAACGGAAGCTGGGGCCCGAGGAGAGGAAGACACACATGCCTTTCCAGAAG<br>GGGATGCCCTTTGACCTCTGCTTCCTGGTGCAGAGCTCAGATTTCAAGGTGATGGTG<br>AACGGGATCCTCTTCGTGCAGTACTTCCACCGCGTGCCCTTCCACCGTGTGGACACC<br>ATCTCCGTCAATGGCTCTGTGCAGCTGTCCTACATCAGCTTCCAGAACCCCCGCACA<br>GTCCCTGTTCAGCCTGCCTTCTCCACGGTGCCGTTCTCCCAGCCTGTCTGTTTCCCA<br>CCCAGGCCCAGGGGCGCAGACAAAAACCTCCCGGCGTGTGGCCTGCCAACCCGGCT<br>CCCATTACCCAGACAGTCATCCACACAGTGCAGAGCGCCCCTGGACAGATGTTCTCT |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | ACTCCCGCCATCCCACCTATGATGTACCCCCACCCCGCCTATCCGATGCCTTTCATC<br>ACCACCATTCTGGGAGGGCTGTACCCATCCAAGTCCATCCTCCTGTCAGGCACTGTC<br>CTGCCCAGTGCTCAGAGGTTCCACATCAACCTGTGCTCTGGGAACCACATCGCCTTC<br>CACCTGAACCCCCGTTTTGATGAGAATGCTGTGGTCCGCAACACCCAGATCGACAAC<br>TCCTGGGGGTCTGAGGAGCGAAGTCTGCCCCGAAAAATGCCCTTCGTCCGTGGCCAG<br>AGCTTCTCAGTGTGGATCTTGTGTGAAGCTCACTGCCTCAAGGTGGCCGTGGATGGT<br>CAGCACCTGTTTGAATACTACCATCGCCTGAGGAACCTGCCCACCATCAACAGACTG<br>GAAGTGGGGGGCGACATCCAGCTGACCCATGTGCAGACAATCGAT*GACAAAACTCAC*<br>*ACATGCCCACCGTGCCCAGCACCTGAACTCCTGGGGGGACCGTCAGTCTTCCTCTTC*<br>*CCCCCAAAACCCAAGGACACCCTCATGATCTCCCGGACCCCTGAGGTCACATGCGTG*<br>*GTGGTGGACGTGAGCCACGAAGACCCTGAGGTCAAGTTCAACTGGTACGTGGACGGC*<br>*GTGGAGGTGCATAATGCCAAGACAAAGCCGCGGGAGGAGCAGTACAACAGCACGTAC*<br>*CGTGTGGTCAGCGTCCTCACCGTCCTGCACCAGGACTGGCTGAATGGCAAGGAGTAC*<br>*AAGTGCAAGGTCTCCAACAAAGCCCTCCCAGCCCCCATCGAGAAAACCATCTCCAAA*<br>*GCCAAAGGGCAGCCCCGAGAACCACAGGTGTACACCCTGCCCCCATCCCGGGAGGAG*<br>*ATGACCAAGAACCAGGTCAGCCTGACCTGCCTGGTCAAAGGCTTCTATCCCAGCGAC*<br>*ATCGCCGTGGAGTGGGAGAGCAATGGGCAGCCGGAGAACAACTACAAGACCACGCCT*<br>*CCCGTGCTGGACTCCGACGGCTCCTTCTTCCTCTACAGCAAGCTCACCGTGGACAAG*<br>*AGCAGGTGGCAGCAGGGGAACGTCTTCTCATGCTCCGTGATGCACGAGGCTCTGCAC*<br>*AACCACTACACGCAGAAGAGCCTCTCCCTGTCTCCGGGTAAAATCGAT*CCAAATAAA<br>*GGAAGTGGAACCACTTCAGGTACTACCCGTCTTCTATCTGGGCACACGTGTTTCACG*<br>*TTGACAGGTTTGCTTGGGACGCTAGTAACCATGGGCTTGCTGACTTAG*<br>(SEQ ID NO: 269)<br>>Artificial Sequence; hGal9-Fc-*GPI*, Amino Acid<br>MAFSGSQAPYLSPAVPFSGTIQGGLQDGLQITVNGTVLSSSGTRFAVNFQTGFSGND<br>IAFHFNPRFEDGGYVVCNTRQNGSWGPEERKTHMPFQKGMPFDLCFLVQSSDFKVMV<br>NGILFVQYFHRVPFHRVDTISVNGSVQLSYISFQNPRTVPVQPAFSTVPFSQPVCFP<br>PRPRGRRQKPPGVWPANPAPITQTVIHTVQSAPGQMFSTPAIPPMMYPHPAYPMPFI<br>TTILGGLYPSKSILLSGTVLPSAQRFHINLCSGNHIAFHLNPRFDENAVVRNTQIDN<br>SWGSEERSLPRKMPFVRGQSFSVWILCEAHCLKVAVDGQHLFEYYHRLRNLPTINRL<br>EVGGDIQLTHVQT<u>I</u>DDKTHTCPPCPAPELLGGPSVFLFPPKPKDTLMISRTPEVTCV<br><u>VVDVSHEDPEVKFNWYVDGVEVHNAKTKPREEQYNSTYRVVSVLTVLHQDWLNGKEY</u><br><u>KCKVSNKALPAPIEKTISKAKGQPREPQVYTLPPSREEMTKNQVSLTCLVKGFYPSD</u><br><u>IAVEWESNGQPENNYKTTPPVLDSDGSFFLYSKLTVDKSRWQQGNVFSCSVMHEALH</u><br><u>NHYTQKSLSLSPGKID</u>*PNKGSGTTSGTTRLLSGHTCFTLTGLLGTLVTMGLLT*<br>(SEQ ID NO: 270) |
| hCD200-GPI | >Artificial Sequence; hCD200-*GPI*, DNA<br>ATGGAGAGGCTGGTGATCAGGATGCCCTTCTCTCATCTGTCTACCTACAGCCTGGTT<br>TGGGTCATGGCAGCAGTGGTGCTGTGCACAGCACAAGTGCAAGTGGTGACCCAGGAT<br>GAAAGAGAGCAGCTGTACACACCTGCTTCCTTAAAATGCTCTCTGCAAAATGCCCAG<br>GAAGCCCTCATTGTGACATGGCAGAAAAAGAAAGCTGTAAGCCCAGAAAACATGGTC<br>ACCTTCAGCGAGAACCATGGGGTGGTGATCCAGCCTGCCTATAAGGACAAGATAAAC<br>ATTACCCAGCTGGGACTCCAAAACTCAACCATCACCTTCTGGAATATCACCCTGGAG<br>GATGAAGGGTGTTACATGTGTCTCTTCAATACCTTTGGTTTTGGGAAGATCTCAGGA<br>ACGGCCTGCCTCACCGTCTATGTACAGCCCATAGTATCCCTTCACTACAAATTCTCT<br>GAAGACCACCTAAATATCACTTGCTCTGCCACTGCCCGCCCAGCCCCCATGGTCTTC<br>TGGAAGGTCCCTCGGTCAGGGATTGAAAATAGTACAGTGACTCTGTCTCACCCAAAT<br>GGGACCACGTCTGTTACCAGCATCCTCCATATCAAAGACCCTAAGAATCAGGTGGGG<br>AAGGAGGTGATCTGCCAGGTGCTGCACCTGGGGACTGTGACCGACTTTAAGCAAACC<br>GTCAACAAAGGC*CCAAATAAAGGAAGTGGAACCACTTCAGGTACTACCCGTCTTCTA*<br>*TCTGGGCACACGTGTTTCACGTTGACAGGTTTGCTTGGGACGCTAGTAACCATGGGC*<br>*TTGCTGACTTAG*<br>(SEQ ID NO: 271)<br>>Artificial Sequence; hCD200-*GPI*, Amino Acid<br>MERLVIRMPFSHLSTYSLVWVMAAVVLCTAQVQVVTQDEREQLYTPASLKCSLQNAQ<br>EALIVTWQKKKAVSPENMVTFSENHGVVIQPAYKDKINITQLGLQNSTITFWNITLE<br>DEGCYMCLFNTFGFGKISGTACLTVYVQPIVSLHYKFSEDHLNITCSATARPAPMVF<br>WKVPRSGIENSTVTLSHPNGTTSVTSILHIKDPKNQVGKEVICQVLHLGTVTDFKQT<br>VNKG*PNKGSGTTSGTTRLLSGHTCFTLTGLLGTLVTMGLLT*<br>(SEQ ID NO: 272) |
| hGal9-GPI | >Artificial Sequence; hGal9-*GPI*, DNA<br>ATGGCCTTCAGCGGTTCCCAGGCTCCCTACCTGAGTCCAGCTGTCCCCTTTTCTGGG<br>ACTATTCAAGGAGGTCTCCAGGACGGACTTCAGATCACTGTCAATGGGACCGTTCTC<br>AGCTCCAGTGGAACCAGGTTTGCTGTGAACTTTCAGACTGGCTTCAGTGGAAATGAC<br>ATTGCCTTCCACTTCAACCCTCGGTTTGAAGATGGAGGGTACGTGGTGTGCAACACG<br>AGGCAGAACGGAAGCTGGGGCCCGAGGAGAGGAAGACACACATGCCCTTTCCAGAAG<br>GGGATGCCCTTTGACCTCTGCTTCCTGGTGCAGAGCTCAGATTTCAAGGTGATGGTG<br>AACGGGATCCTCTTCGTGCAGTACTTCCACCGCGTGCCCTTCCACCGTGTGGACACC<br>ATCTCCGTCAATGGCTCTGTGCAGCTGTCCTACATCAGCTTCCAGAACCCCCGCACA<br>GTCCCTGTTCAGCCTGCCTTCTCCACGGTGCCGTTCTCCCAGCCTGTCTGTTTCCCA<br>CCCAGGCCCAGGGGCGCAGACAAAAACCTCCCGGCGTGTGGCCTGCCAACCCGGCT<br>CCCATTACCCAGACAGTCATCCACACAGTGCAGAGCGCCCCTGGACAGATGTTCTCT<br>ACTCCCGCCATCCCACCTATGATGTACCCCCACCCCGCCTATCCGATGCCTTTCATC |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | ACCACCATTCTGGGAGGGCTGTACCCATCCAAGTCCATCCTCCTGTCAGGCACTGTC<br>CTGCCCAGTGCTCAGAGGTTCCACATCAACCTGTGCTCTGGGAACCACATCGCCTTC<br>CACCTGAACCCCCGTTTTGATGAGAATGCTGTGGTCCGCAACACCCAGATCGACAAC<br>TCCTGGGGGTCTGAGGAGCGAAGTCTGCCCCGAAAAATGCCCTTCGTCCGTGGCCAG<br>AGCTTCTCAGTGTGGATCTTGTGTGAAGCTCACTGCCTCAAGGTGGCCGTGGATGGT<br>CAGCACCTGTTTGAATACTACCATCGCCTGAGGAACCTGCCCACCATCAACAGACTG<br>GAAGTGGGGGGCGACATCCAGCTGACCCATGTGCAGACA*CCAAATAAAGGAAGTGGA<br>ACCACTTCAGGTACTACCCGTCTTCTATCTGGGCACACGTGTTTCACGTTGACAGGT<br>TTGCTTGGGACGCTAGTAACCATGGGCTTGCTGACTTAG*<br>(SEQ ID NO: 273)<br>>Artificial Sequence; hGal9-GPI, Amino Acid<br>MAFSGSQAPYLSPAVPFSGTIQGGLQDGLQITVNGTVLSSSGTRFAVNFQTGFSGND<br>IAFHFNPRFEDGGYVVCNTRQNGSWGPEERKTHMPFQKGMPFDLCFLVQSSDFKVMV<br>NGILFVQYFHRVPFHRVDTISVNGSVQLSYISFQNPRTVPVQPAFSTVPFSQPVCFP<br>PRPRGRRQKPPGVWPANPAPITQTVIHTVQSAPGQMPSTPAIPPMMYPHPAYPMPFI<br>TTILGGLYPSKSILLSGTVLPSAQRFHINLCSGNHIAFHLNPRFDENAVVRNTQIDN<br>SWGSEERSLPRKMPFVRGQSFSVWILCEAHCLKVAVDGQHLFEYYHRLRNLPTINRL<br>EVGGDIQLTHVQT*PNKGSGTTSGTTRLLSGHTCFTLTGLLGTLVTMGLLT*<br>(SEQ ID NO: 274) |
| hHVEM-GPI | >Artificial Sequence; hHVEM-GPI, DNA<br>*ATGGAGCCTCCTGGAGACTGGGGGCCTCCTCCCTGGAGATCCACCCCCAAAACCGAC<br>GTCTTGAGGCTGGTGCTGTATCTCACCTTCCTGGGAGCCCCCTGCTACGCCCCAGCT<br>CTGCCGTCCTGCAAGGAGGACGAGTACCCAGTGGGCTCCGAGTGCTGCCCCAAGTGC<br>AGTCCAGGTTATCGTGTGAAGGAGGCCTGCGGGAGCTGACGGGCACAGTGTGTGAA<br>CCCTGCCCTCCAGGCACCTACATTGCCCACCTCAATGGCCTAAGCAAGTGTCTGCAG<br>TGCCAAATGTGTGACCCAGCCATGGGCCTGCGCGCGAGCCGGAACTGCTCCAGGACA<br>GAGAACGCCGTGTGTGGCTGCAGCCCAGGCCACTTCTGCATCGTCCAGGACGGGGAC<br>CACTGCGCCGCGTGCCGCGCTTACGCCACTTCCAGCCCGGGCCAGAGGGTGCAGAAG<br>GGAGGCACCGAGAGTCAGGACACCCTGTGTCAGAACTGCCCCCCGGGGACCTTCTCT<br>CCCAATGGGACCCTGGAGGAATGTCAGCACCAGACCAAGTGCAGCTGGCTGGTGACG<br>AAGGCCGGAGCTGGGACCAGCAGCTCCCAC**CCAAATAAAGGAAGTGGAACC<br>ACTTCAGGTACTACCCGTCTTCTATCTGGGCACACGTGTTTCACGTTGACAGGTTTG<br>CTTGGGACGCTAGTAACCATGGGCTTGCTGACTTAG*<br>(SEQ ID NO: 275)<br>>Artificial Sequence; hHVEM-GPI, Amino Acid<br>MEPPGDWGPPPWRSTPKTDVLRLVLYLTFLGAPCYAPALPSCKEDEYPVGSECCPKC<br>SPGYRVKEACGELTGTVCEPCPPGTYIAHLNGLSKCLQCQMCDPAMGLRASRNCSRT<br>ENAVCGCSPGHFCIVQDGDHCAACRAYATSSPGQRVQKGGTESQDTLCQNCPPGTFS<br>PNGTLEECQHQTKCSWLVTKAGAGTSSSHWV*PNKGSGTTSGTTRLLSGHTCFTLTGL<br>LGTLVTMGLLT*<br>(SEQ ID NO: 276) |
| hPDL2-GPI | >Artificial Sequence; hPDL2-GPI, DNA<br>ATGATCTTCCTCCTGCTAATGTTGAGCCTGGAATTGCAGCTTCACCAGATAGCAGCT<br>TTATTCACAGTGACAGTCCCTAAGGAACTGTACATAATAGAGCATGGCAGCAATGTG<br>ACCCTGGAATGCAACTTTGACACTGGAAGTCATGTGAACCTTGGAGCAATAACAGCC<br>AGTTTGCAAAAGGTGGAAAATGATACATCCCCACACCGTGAAAGAGCCACTTTGCTG<br>GAGGAGCAGCTGCCCCTAGGGAAGGCCTCGTTCCACATACCTCAAGTCCAAGTGAGG<br>GACGAAGGACAGTACCAATGCATAATCATCTATGGGGTCGCCTGGGACTACAAGTAC<br>CTGACTCTGAAAGTCAAAGCTTCCTACAGGAAAATAAACACTCACATCCTAAAGGTT<br>CCAGAAACAGATGAGGTAGAGCTCACCTGCCAGGCTACAGGTTATCCTCTGGCAGAA<br>GTATCCTGGCCAAACGTCAGCGTTCCTGCCAACACCAGCCACTCCAGGACCCCTGAA<br>GGCCTCTACCAGGTCACCAGTGTTCTGCGCCTAAAGCCACCCCCTGGCAGAAACTTC<br>AGCTGTGTGTTCTGGAATACTCACGTGAGGGAACTTACTTTGGCCAGCATTGACCTT<br>CAAAGTCAGATGGAACCCAGGACCCATCCAACT*CCAAATAAAGGAAGTGGAACCACT<br>TCAGGTACTACCCGTCTTCTATCTGGGCACACGTGTTTCACGTTGACAGGTTTGCTT<br>GGGACGCTAGTAACCATGGGCTTGCTGACTTAG*<br>(SEQ ID NO: 277)<br>>Artificial Sequence; hPDL2-GPI, Amino Acid<br>MIFLLLMLSLELQLHQIAALFTVTVPKELYIIEHGSNVTLECNFDTGSHVNLGAITA<br>SLQKVENDTSPHRERATLLEEQLPLGKASFHIPQVQVRDEGQYQCIIIYGVAWDYKY<br>LTLKVKASYRKINTHILKVPETDEVELTCQATGYPLAEVSWPNVSVPANTSHSRTPE<br>GLYQVTSVLRLKPPPGRNFSCVFWNTHVRELTLASIDLQSQMEPRTHPT*PNKGSGTT<br>SGTTRLLSGHTCFTLTGLLGTLVTMGLLT*<br>(SEQ ID NO: 278) |
| hTSG6-GPI | >Artificial Sequence; hTSG6-GPI, DNA<br>ATGATCATCTTAATTTACTTATTTCTCTTGCTATGGGAAGACACTCAAGGATGGGA<br>TTCAAGGATGGAATTTTTCATAACTCCATATGGCTTGAACGAGCAGCCGGTGTGTAC<br>CACAGAGAAGCACGGTCTGGCAAATACAAGCTCACCTACGCAGAAGCTAAGGCGGTG<br>TGTGAATTTGAAGGCGGCCATCTCGCAACTTACAAGCAGCTAGAGGCAGCCAGAAAA<br>ATTGGATTTCATGTCTGTGCTGCTGGATGGATGGCTAAGGGCAGAGTTGGATACCCC<br>ATTGTGAAGCCAGGGCCCAACTGTGGATTTGGAAAAACTGGCATTATTGATTATGGA<br>ATCCGTCTCAATAGGAGTGAAAGATGGGATGCCTATTGCTACAACCCACACGCAAAG |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | GAGTGTGGTGGCGTCTTTACAGATCCAAAGCAAATTTTTAAATCTCCAGGCTTCCCA<br>AATGAGTACGAAGATAACCAAATCTGCTACTGGCACATTAGACTCAAGTATGGTCAG<br>CGTATTCACCTGAGTTTTTTAGATTTTGACCTTGAAGATGACCCAGGTTGCTTGGCT<br>GATTATGTTGAAATATATGACAGTTACGATGATGTCCATGGCTTTGTGGGAAGATAC<br>TGTGGAGATGAGCTTCCAGATGACATCATCAGTACAGGAAATGTCATGACCTTGAAG<br>TTTCTAAGTGATGCTTCAGTGACAGCTGGAGGTTTCCAAATCAAATATGTTGCAATG<br>GATCCTGTATCCAAATCCAGTCAAGGAAAAAAATACAAGTACTACTTCTACTGGAAAT<br>AAAAACTTTTTAGCTGGAAGATTTAGCCACTTAATCGATCCAAATAAAGGAAGTGGA<br>ACCACTTCAGGTACTACCCGTCTTCTATCTGGGCACACGTGTTTCACGTTGACAGGT<br>TTGCTTGGGACGCTAGTAACCATGGGCTTGCTGACTTAG<br>(SEQ ID NO: 279)<br>>Artificial Sequence; hTSG6-GPI, Amino Acid<br>MIILIYLFLLLWEDTQGWGFKDGIFHNSIWLERAAGVYHREARSGKYKLTYAEAKAV<br>CEFEGGGHLATYKQLEAARKIGFHVCAAGWMAKGRVGYPIVKPGPNCGFGKTGIIDYG<br>IRLNRSERWDAYCYNPHAKECGGVFTDPKQIFKSPGFPNEYEDNQICYWHIRLKYGQ<br>RIHLSFLDFDLEDDPGCLADYVEIYDSYDDVHGFVGRYCGDELPDDIISTGNVMTLK<br>FLSDASVTAGGFQIKYVAMDPVSKSSQGKNTSTTSTGNKNFLAGRFSHLIDPNKGSG<br>TTSGTTRLLSGHTCFTLTGLLGTLVTMGLLT<br>(SEQ ID NO: 280) |
| hHVEM-Fc-GPI | >Artificial Sequence; hHVEM-Fc-GPI, DNA<br>ATGGAGCCTCCTGGAGACTGGGGGCCTCCTCCCTGGAGATCCACCCCCAAAACCGAC<br>GTCTTGAGGCTGGTGCTGTATCTCACCTTCCTGGGAGCCCCCTGCTACGCCCCAGCT<br>CTGCCGTCCTGCAAGGAGGACGAGTACCCAGTGGGCTCCGAGTGCTGCCCCAAGTGC<br>AGTCCAGGTTATCGTGTGAAGGAGGCCTGCGGGGAGCTGACGGGCACAGTGTGTGAA<br>CCCTGCCCTCCAGGCACCTACATTGCCCACCTCAATGGCCTAAGCAAGTGTCTGCAG<br>TGCCAAATGTGTGACCCAGCCATGGGCCTGCGCGCGAGCCGGAACTGCTCCAGGACA<br>GAGAACGCCGTGTGTGGCTGCAGCCCAGGCCACTTCTGCATCGTCCAGGACGGGGAC<br>CACTGCGCCGCGTGCCGCGCTTACGCCACCTCCAGCCCGGGCCAGAGGGTGCAGAAG<br>GGAGGCACCGAGAGTCAGGACACCCTGTGTCAGAACTGCCCCCCGGGGACCTTCTCT<br>CCCAATGGGACCCTGGAGGAATGTCAGCACCAGACCAAGTGCAGCTGGCTGGTGACG<br>AAGGCCGGAGCTGGGACCAGCAGCTCCCACTGGGTAATCGATGACAAAACTCACACA<br>TGCCCACCGTGCCCAGCACCTGAACTCCTGGGGGGACCGTCAGTCTTCCTCTTCCCC<br>CCAAAACCCAAGGACACCCTCATGATCTCCCGGACCCCTGAGGTCACATGCGTGGTG<br>GTGGACGTGAGCCACGAAGACCCTGAGGTCAAGTTCAACTGGTACGTGGACGGCGTG<br>GAGGTGCATAATGCCAAGACAAAGCCGCGGGAGGAGCAGTACAACAGCACGTACCGT<br>GTGGTCAGCGTCCTCACCGTCCTGCACCAGGACTGGCTGAATGGCAAGGAGTACAAG<br>TGCAAGGTCTCCAACAAAGCCCTCCCAGCCCCCATCGAGAAAACCATCTCCAAAGCC<br>AAAGGGCAGCCCCGAGAACCACAGGTGTACACCCTGCCCCCATCCCGGGAGGAGATG<br>ACCAAGAACCAGGTCAGCCTGACCTGCCTGGTCAAAGGCTTCTATCCCAGCGACATC<br>GCCGTGGAGTGGGAGAGCAATGGGCAGCCGGAGAACAACTACAAGACCACGCCTCCC<br>GTGCTGGACTCCGACGGCTCCTTCTTCCTCTACAGCAAGCTCACCGTGGACAAGAGC<br>AGGTGGCAGCAGGGGAACGTCTTCTCATGCTCCGTGATGCACGAGGCTCTGCACAAC<br>CACTACACGCAGAAGAGCCTCTCCCTGTCTCCGGGTAAATCGATCCAAATAAAGGA<br>AGTGGAACCACTTCAGGTACTACCCGTCTTCTATCTGGGCACACGTGTTTCACGTTG<br>ACAGGTTTGCTTGGGACGCTAGTAACCATGGGCTTGCTGACTTAG<br>(SEQ ID NO: 281)<br>>Artificial Sequence; hHVEM-Fc-GPI, Amino Acid<br>MEPPPGDWGPPPWRSTPKTDVLRLVLYLTFLGAPCYAPALPSCKEDEYPVGSECCPKC<br>SPGYRVKEACGELTGTVCEPCPPGTYIAHLNGLSKCLQCQMCDPAMGLRASRNCSRT<br>ENAVCGCSPGHFCIVQDGDHCAARAYATSSPGQRVQKGGTESQDTLCQNCPPGTFS<br>PNGTLEECQHQTKCSWLVTKAGAGTSSSHWVIDDKTHTCPPCPAPELLGGPSVFLFP<br>PKPKDTLMISRTPEVTCVVVDVSHEDPEVKFNWYVDGVEVHNAKTKPREEQYNSTYR<br>VVSVLTVLHQDWLNGKEYKCKVSNKALPAPIEKTISKAKGQPREPQVYTLPPSREEM<br>TKNQVSLTCLVKGFYPSDIAVEWESNGQPENNYKTTPPVLDSDGSFFLYSKLTVDKS<br>RWQQGNVFSCSVMHEALHNHYTQKSLSLSPGKIDPNKGSGTTSGTTRLLSGHTCFTL<br>TGLLGTLVTMGLLT<br>(SEQ ID NO: 282) |
| hPDL1-GPI-P2A-<br>hHVEM-GPI | >Artificial Sequence; hPDL1-GPI-P2A-hHVEM-GPI, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAACAATTAGACCTGGCTGCACTAATTGTCTATTGG<br>GAAATGGAGGATAAGAACATTATTCAATTTGTCATGGAGAGGAAGACCTGAAGGTT<br>CAGCATAGTAGCTACAGACAGAGGGCCCGGCTGTTGAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCCAAGAGAGAGGAGAAGCTT<br>TTCAATGTGACCAGCACACTGAGAATCAACACAACAACTAATGAGATTTTCTACTGC<br>ACTTTTAGGAGATTAGATCCTGAGGAAAACCATACAGCTGAATTGGTCATCCCAGAA<br>CTACCTCTGGCACATCCTCCAAATGAAAGGCCAAATAAAGGAAGTGGAACCACTTCA<br>GGTACTACCCGTCTTCTATCTGGGCACACGTGTTTCACGTTGACAGGTTTGCTTGGG<br>ACGCTAGTAACCATGGGCTTGCTGACTGGAAGCGGAGCTACTAACTTCAGCCTGCTG |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | AAGCAGGCTGGCGACGTGGAGGAGAACCCTGGACCTATGGAGCCTCCTGGAGACTGG<br>GGGCCTCCTCCCTGGAGATCCACCCCCAAAACCGACGTCTTGAGGCTGGTGCTGTAT<br>CTCACCTTCCTGGGAGCCCCCTGCTACGCCCCAGCTCTGCCGTCCTGCAAGGAGGAC<br>GAGTACCCAGTGGGCTCCGAGTGCTGCCCCAAGTGCAGTCCAGGTTATCGTGTGAAG<br>GAGGCCTGCGGGGAGCTGACGGGCACAGTGTGTGAACCCTGCCCTCCAGGCACCTAC<br>ATTGCCCACCTCAATGGCCTAAGCAAGTGTCTGCAGTGCCAAATGTGTGACCCAGCC<br>ATGGGCCTGCGCGCGAGCCGGAACTGCTCCAGGACAGAGAACGCCGTGTGTGGCTGC<br>AGCCCCAGGCCACTTCTGCATCGTCCAGGACGGGGACCACTGCGCCGCGTGCCGCGCT<br>TACGCCACCTCCAGCCCGGGCCAGAGGGTGCAGAAGGGAGGCACCGAGAGTCAGGAC<br>ACCCTGTGTCAGAACTGCCCCCCGGGGACCTTCTCTCCCAATGGGACCCTGGAGGAA<br>TGTCAGCACCAGACCAAGTGCAGCTGGCTGGTGACGAAGGCCGGAGCTGGGACCAGC<br>AGCTCCCACTGGGTACCAAATAAAGGAAGTGGAACCACTTCAGGTACTACCCGTCTT<br>CTATCTGGGCACACGTGTTTCACGTTGACAGGTTTGCTTGGGACGCTAGTAACCATG<br>GGCTTGCTGACTTAG<br>(SEQ ID NO: 283)<br>>Artificial Sequence; hPDL1-*GPI*-P2A-hHVEM-*GPI*, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPE<br>LPLAHPPNER*PNKGSGTTSGTTRLLSGHTCFTLTGLLGTLVTMGLLTGSG*ATNFSLL<br>KQAGDVEENPGPMEPPGDWGPPPWRSTPKTDVLRLVLYLTFLGAPCYAPALPSCKED<br>EYPVGSECCPKCSPGYRVKEACGELTGTVCEPCPPGTYIAHLNGLSKCLQCQMCDPA<br>MGLRASRNCSRTENAVCGCSPGHFCIVQDGDHCAACRAYATSSPGQRVQKGGTESQD<br>TLCQNCPPGTFSPNGTLEECQHQTKCSWINTKAGAGTSSSHWV*PNKGSGTTSGTTRL<br>LSGHTCFTLTGLLGTLVTMGLLT*<br>(SEQ ID NO: 284) |
| mCTLA4-Fc-GPI | >Artificial Sequence; mCTLA4-Fc-*GPI*, DNA<br>ATGGCTTGTCTTGGACTCCGGAGGTACAAAGCTCAACTGCAGCTGCCTTCTAGGACT<br>TGGCCTTTTGTAGCCCTGCTCACTCTTCTTTTCATCCCAGTCTTCTCTGAAGCCATA<br>CAGGTGACCCAACCTTCAGTGGTGTTGGCTAGCAGCCATGGTGTCGCCAGCTTTCCA<br>TGTGAATATTCACCATCACACAACACTGATGAGGTCCGGGTGACTGTGCTGCGGCAG<br>ACAAATGACCAAATGACTGAGGTCTGTGCCACGACATTCACAGAGAAGAATACAGTG<br>GGCTTCCTAGATTACCCCTTCTGCAGTGGTACCTTTAATGAAAGCAGAGTGAACCTC<br>ACCATCCAAGGACTGAGAGCTGTTGACACGGGACTGTACCTCTGCAAGGTGGAACTC<br>ATGTACCCACCGCCATACTTTGTGGGCATGGGCAACGGGACGCAGATTTATGTCATT<br>GATCCAGAACCATGCCCGGATTCTGAATCGATGACAAAACTCACACATGCCCACCGT<br>GCCCAGCACCTGAACTCCTGGGGGGACCGTCAGTCTTCCTCTTCCCCCCAAAACCCA<br>AGGACACCCTCATGATCTCCCGGACCCCTGAGGTCACATGCGTGGTGGTGGACGTGA<br>GCCACGAAGACCCTGAGGTCAAGTTCAACTGGTACGTGGACGGCGTGGAGGTGCATA<br>ATGCCAAGACAAAGCCGCGGGAGGAGCAGTACAACAGCACGTACCGTGTGGTCAGCG<br>TCCTCACCGTCCTGCACCAGGACTGGCTGAATGGCAAGGAGTACAAGTGCAAGGTCT<br>CCAACAAAGCCCTCCCAGCCCCCATCGAGAAAACCATCTCCAAAGCCAAAGGGCAGC<br>CCCGAGAACCACAGGTGTACACCCTGCCCCCATCCCGGGAGGAGATGACCAAGAACC<br>AGGTCAGCCTGACCTGCCTGGTCAAAGGCTTCTATCCCAGCGACATCGCCGTGGAGT<br>GGGAGAGCAATGGGCAGCCGGAGAACAACTACAAGACCACGCCTCCCGTGCTGGACT<br>CCGACGGCTCCTTCTTCCTCTACAGCAAGCTCACCGTGGACAAGAGCAGGTGGCAGC<br>AGGGGAACGTCTTCTCATGCTCCGTGATGCACGAGGCTCTGCACAACCACTACACGC<br>AGAAGAGCCTCTCCCTGTCTCCGGGTAAAATCGAT*CCAAATAAAGGAAGTGGAACCA<br>CTTCAGGTACTACCCGTCTTCTATCTGGGCACACGTGTTTCACGTTGACAGGTTTGC<br>TTGGGACGCTAGTAACCATGGGCTTGCTGACTTAG*<br>(SEQ ID NO: 285)<br>>Artificial Sequence; mCTLA4-Fc-*GPI*, Amino Acid<br>MACLGLRRYKAQLQLPSRTWPFVALLTLLFIPVFSEAIQVTQPSVVLASSHGVASFP<br>CEYSPSHNTDEVRVTVLRQTNDQMTEVCATTFTEKNTVGFLDYPFCSGTFNESRVNL<br>TIQGLRAVDTGLYLCKVELMYPPPYFVGMGNGTQIYVIDPEPCPDSD<br>IDDKTHTCPPCPAPELLGGPSVFLFPPKPKDTLMISRTPEVTCVVVDVSHEDPEVKF<br>NWYVDGVEVHNAKTKPREEQYNSTYRVVSVLTVLHQDWLNGKEYKCKVSNKALPAPI<br>EKTISKAKGQPREPQVYTLPPSREEMTKNQVSLTCLVKGFYPSDIAVEWESNGQPEN<br>NYKTTPPVLDSDGSFFLYSKLTVDKSRWQQGNVFSCSVMHEALHNHYTQKSLSLSPG<br>KID*PNKGSGTTSGTTRLLSGHTCFTLTGLLGTLVTMGLLT*<br>(SEQ ID NO: 286) |
| mPDL1-C1C2 | >Artificial Sequence; mPDL1-*C1C2*, DNA<br>ATGAGGATATTTGCTGGCATTATATTCACAGCCTGCTGTCACTTGCTACGGGCGTTT<br>ACTATCACGGCTCCAAAGGACTTGTACGTGGTGGAGTATGGCAGCAACGTCACGATG<br>GAGTGCAGATTCCCTGTAGAACGGGAGCTGGACCTGCTTGCGTTAGTGGTGTACTGG<br>GAAAAGGAAGATGAGCAAGTGATTCAGTTTGTGGCAGGAGAGGAGGACCTTAAGCCT<br>CAGCACAGCAACTTCAGGGGGAGAGCCTCGCTGCCAAAGGACCAGCTTTTGAAGGGA<br>AATGCTGCCCTTCAGATCACAGACGTCAAGCTGCAGGACGCAGGCGTTTACTGCTGC<br>ATAATCAGCTACGGTGGTGCGGACTACAAGCGAATCACGCTGAAAGTCAATGCCCCA<br>TACCGCAAAATCAACCAGAGAATTTCCGTGGATCCAGCCACTTCTGAGCATGAACTA<br>ATATGTCAGGCCGAGGGTTATCCAGAAGCTGAGGTAATCTGGACAAACAGTGACCAC<br>CAACCCGTGAGTGGGAAGAGAAGTGTCACCACTTCCCGGACAGAGGGGATGCTTCTC |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | AATGTGACCAGCAGTCTGAGGGTCAACGCCACAGCGAATGATGTTTTCTACTGTACG<br>TTTTGGAGATCACAGCCAGGGCAAAACCACACAGCGGAGCTGATCATCCCAGAACTG<br>CCTGCAACACATCCTCCACAGAACAGGACTATCGAT*GTCGAGCCACTGGGCATGGAG<br>AATGGGAACATTGCCAACTCACAGATCGCCGCCTCATCTGTGCGTGTGACCTTCTTG<br>GGTTTGCAGCATTGGGTCCCGGAGCTGGCCCGCCTGAACCGCGCAGGCATGGTCAAT<br>GCCTGGACACCCAGCAGCAATGACGATAACCCCTGGATCCAGGTGAACCTGCTGCGG<br>AGGATGTGGGTAACAGGTGTGGTGACGCAGGGTGCCAGCCGCTTGGCCAGTCATGAG<br>TACCTGAAGGCCTTCAAGGTGGCCTACAGCCTTAATGGACACGAATTCGATTTCATC<br>CATGATGTTAATAAAAAACACAAGGAGTTTGTGGGTAACTGGAACAAAAACGCGGTG<br>CATGTCAACCTGTTTGAGACCCCTGTGGAGGCTCAGTACGTGAGATTGTACCCACG<br>AGCTGCCACACGGCCTGCACTCTGCGCTTTGAGCTACTGGGCTGTGAGCTGAACGGA<br>TGCGCCAATCCCCTGGGCCTGAAGAATAACAGCATCCCTGACAAGCAGATCACGGCC<br>TCCAGCAGCTACAAGACCTGGGGCTTGCATCTCTTCAGCTGGAACCCCTCCTATGCA<br>CGGCTGGACAAGCAGGGCAACTTCAACGCCTGGGTTGCGGGGAGCTACGGTAACGAT<br>CAGTGGCTGCAGATCTTCCCTGGCAACTGGGACAACCACTCCCACAAGAAGAACTTG<br>TTTGAGACGCCCATCCTGGCTCGCTATGTGCGCATCCTGCCTGTAGCCTGGCACAAC<br>CGCATCGCCCTGCGCCTGGAGCTGCTGGGCTGTTAG*<br>(SEQ ID NO: 287)<br>>Artificial Sequence; mPDL1-C1C2, Amino Acid<br>MRIFAGIIFTACCHLLRAFTITAPKDLYVVEYGSNVTMECRFPVERELDLLALVVYW<br>EKEDEQVIQFVAGEEDLKPQHSNFSGRASLPKDQLLKGNAALQITDVKLQDAGVYCC<br>IISYGGADYKRITLKVNAPYRKINQRISVDPATSEHELICQAEGYPEAEVIWTNSDH<br>QPVSGKRSVTTSRTEGMLLNVTSSLRVNATANDVFYCTFWRSQPGQNHTAELIIPEL<br>PATHPPQNRT*IDVEPLGMENGNIANSQIAASSVRVTFLGLQHWVPELARLNRAGMVN<br>AWTPSSNDDNPWIQVNLLRRMWVTGVVTQGASRLASHEYLKAFKVAYSLNGHEFDFI<br>HDVNKKHKEFVGNWNKNAVHVNLFETPVEAQYVRLYPTSCHTACTLRFELLGCELNG<br>CANPLGLKNNSIPDKQITASSSYKTWGLHLFSWNPSYARLDKQGNFNAWVAGSYGND<br>QWLQIFPGNWDNHSHKKNLFETPILARYVRILPVAWHNRIALRLELLGC*<br>(SEQ ID NO: 288) |
| mPDL1-Fc-GPI | >Artificial Sequence; mPDL1-<u>Fc</u>-*GPI*, DNA<br>ATGAGGATATTTGCTGGCATTATATTCACAGCCTGCTGTCACTTGCTACGGGCGTTT<br>ACTATCACGGCTCCAAAGGACTTGTACGTGGTGGAGTATGGCAGCAACGTCACGATG<br>GAGTGCAGATTCCCTGTAGAACGGGAGCTGGACCTGCTTGCGTTAGTGGTGTACTGG<br>GAAAAGGAAGATGAGCAAGTGATTCAGTTTGTGGCAGGAGAGGAGGACCTTAAGCCT<br>CAGCACAGCAACTTCAGGGGGAGAGCCTCGCTGCCAAAGGACCAGCTTTTGAAGGGA<br>AATGCTGCCCTTCAGATCACAGACGTCAAGCTGCAGGACGCAGGCGTTTACTGCTGC<br>ATAATCAGCTACGGTGGTGCGGACTACAAGCGAATCACGCTGAAAGTCAATGCCCCA<br>TACCGCAAAATCAACCAGAGAATTTCCGTGGATCCAGCCACTTCTGAGCATGAACTA<br>ATATGTCAGGCCGAGGGTTATCCAGAAGCTGAGGTAATCTGGACAAACAGTGACCAC<br>CAACCCGTGAGTGGGAAGAGAAGTGTCACCACTTCCCGGACAGAGGGGATGCTTCTC<br>AATGTGACCAGCAGTCTGAGGGTCAACGCCACAGCGAATGATGTTTTCTACTGTACG<br>TTTTGGAGATCACAGCCAGGGCAAAACCACACAGCGGAGCTGATCATCCCAGAACTG<br>CCTGCAACACATCCTCCACAGAACAGGACTATCGAT<u>GACAAAACTCACACATGCCCA<br>CCGTGCCCAGCACCTGAACTCCTGGGGGGACCGTCAGTCTTCCTCTTCCCCCCAAAA<br>CCCAAGGACACCCTCATGATCTCCCGGACCCCTGAGGTCACATGCGTGGTGGTGGAC<br>GTGAGCCACGAAGACCCTGAGGTCAAGTTCAACTGGTACGTGGACGGCGTGGAGGTG<br>CATAATGCCAAGACAAAGCCGCGGGAGGAGCAGTACAACAGCACGTACCGTGTGGTC<br>AGCGTCCTCACCGTCCTGCACCAGGACTGGCTGAATGGCAAGGAGTACAAGTGCAAG<br>GTCTCCAACAAAGCCCTCCCAGCCCCCATCGAGAAAACCATCTCCAAAGCCAAAGGG<br>CAGCCCCGAGAACCACAGGTGTACACCCTGCCCCCATCCCGGGAGGAGATGACCAAG<br>AACCAGGTCAGCCTGACCTGCCTGGTCAAAGGCTTCTATCCCAGCGACATCGCCGTG<br>GAGTGGGAGAGCAATGGGCAGCCGGAGAACAACTACAAGACCACGCCTCCCGTGCTG<br>GACTCCGACGGCTCCTTCTTCCTCTACAGCAAGCTCACCGTGGACAAGAGCAGGTGG<br>CAGCAGGGGAACGTCTTCTCATGCTCCGTGATGCACGAGGCTCTGCACAACCACTAC<br>ACGCAGAAGAGCCTCTCCCTGTCTCCGGGTAAA</u>ATCGAT*CCAAATAAAGGAAGTGGA<br>ACCACTTCAGGTACTACCCGTCTTCTATCTGGGCACACGTGTTTCACGTTGACAGGT<br>TTGCTTGGGACGCTAGTAACCATGGGCTTGCTGACTTAG*<br>(SEQ ID NO: 289)<br>>Artificial Sequence; mPDL1-<u>Fc</u>-*GPI*, Amino Acid<br>MRIFAGIIFTACCHLLRAFTITAPKDLYVVEYGSNVTMECRFPVERELDLLALVVYW<br>EKEDEQVIQFVAGEEDLKPQHSNFRGRASLPKDQLLKGNAALQITDVKLQDAGVYCC<br>IISYGGADYKRITLKVNAPYRKINQRISVDPATSEHELICQAEGYPEAEVIWTNSDH<br>QPVSGKRSVTTSRTEGMLLNVTSSLRVNATANDVPYCTFWRSQPGQNHTAELIIPEL<br>PATHPPQNRTID<u>DKTHTCPPCPAPELLGGPSVFLFPPKPKDTLMISRTPEVTCVVVD<br>VSHEDPEVKFNWYVDGVEVHNAKTKPREEQYNSTYRVVSVLTVLHQDWLNGKEYKCK<br>VSNKALPAPIEKTISKAKGQPREPQVYTLPPSREEMTKNQVSLTCLVKGFYPSDIAV<br>EWESNGQPENNYKTTPPVLDSDGSFFLYSKLTVDKSRWQQGNVFSCSVMHEALHNHY<br>TQKSLSLSPGKID</u>*PNKGSGTTSGTTRLLSGHTCFTLTGLLGTLVTMGLLT*<br>(SEQ ID NO: 290) |
| mPDL1-GPI | >Artificial Sequence; mPDL1-*GPI*, DNA<br>ATGAGGATATTTGCTGGCATTATATTCACAGCCTGCTGTCACTTGCTACGGGCGTTT<br>ACTATCACGGCTCCAAAGGACTTGTACGTGGTGGAGTATGGCAGCAACGTCACGATG<br>GAGTGCAGATTCCCTGTAGAACGGGAGCTGGACCTGCTTGCGTTAGTGGTGTACTGG |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | GAAAAGGAAGATGAGCAAGTGATTCAGTTTGTGGCAGGAGAGGAGGACCTTAAGCCT<br>CAGCACAGCAACTTCAGGGGAGAGCCTCGCTGCCAAAGGACCAGCTTTTGAAGGGA<br>AATGCTGCCCTTCAGATCACAGACGTCAAGCTGCAGGACGCAGGCGTTTACTGCTGC<br>ATAATCAGCTACGGTGGTGCGGACTACAAGCGAATCACGCTGAAAGTCAATGCCCCA<br>TACCGCAAAATCAACCAGAGAATTTCCGTGGATCCAGCCACTTCTGAGCATGAACTA<br>ATATGTCAGGCCGAGGGTTATCCAGAAGCTGAGGTAATCTGGACAAACAGTGACCAC<br>CAACCCGTGAGTGGGAAGAGAAGTGTCACCACTTCCCGGAZAGAGGGGATGCTTCTC<br>AATGTGACCAGCAGTCTGAGGGTCAACGCCACAGCGAATGATGTTTTCTACTGTACG<br>TTTTGGAGATCACAGCCAGGGCAAAACCACACAGCGGAGCTGATCATCCCAGAACTG<br>CCTGCAACACATCCTCCACAGAACAGGACT*CCAAATAAAGGAAGTGGAACCACTTCA*<br>*GGTACTACCCGTCTTCTATCTGGGCACACGTGTTTCACGTTGACAGGTTTGCTTGGG*<br>*ACGCTAGTAACCATGGGCTTGCTGACTTAG*<br>(SEQ ID NO: 291)<br>>Artificial Sequence; mPDL1-*GPI*, Amino Acid<br>MRIFAGIIFTACCHLLRAFTITAPKDLYVVEYGSNVTMECRFPVERELDLLALVVYW<br>EKEDEQVIQFVAGEEDLKPQHSNFRGRASLPKDQLLKGNAALQITDVKLQDAGVYCC<br>IISYGGADYKRITLKVNAPYRKINQRISVDPATSEHELICQAEGYPEAEVIWTNSDH<br>QPVSGKRSVTTSRTEGMLLNVTSSLRVNATANDVFYCTFWRSQPGQNHTAELIIPEL<br>PATHPPQNRT*PNKGSGTTSGTTRLLSGHTCFTLTGLLGTLVTMGLLT*<br>(SEQ ID NO: 292) |
| mPDL2-C1C2 | >Artificial Sequence; mPDL2-*C1C2*, DNA<br>ATGCTGCTCCTGCTGCCGATACTGAACCTGAGCTTACAACTTCATCCTGTAGCAGCT<br>TTATTCACCGTGACAGCCCCTAAAGAAGTGTACACCGTAGACGTCGGCAGCAGTGTG<br>AGCCTGGAGTGCGATTTTGACCGCAGAGAATGCACTGAACTGGAAGGGATAAGAGCC<br>AGTTTGCAGAAGGTAGAAAATGATACGTCTCTGCAAAGTGAAAGAGCCACCCTGCTG<br>GAGGAGCAGCTGCCCCTGGGAAAGGCTTTGTTCCACATCCCTAGTGTCCAAGTGAGA<br>GATTCCGGGCAGTACCGTTGCCTGGTCATCTGCGGGGCCGCCTGGGACTACAAGTAC<br>CTGACGGTGAAAGTCAAAGCTTCTTACATGAGGATAGACACTAGGATCCTGGAGGTT<br>CCAGGTACAGGGGAGGTGCAGCTTACCTGCCAGGCTAGAGGTTATCCCCTAGCAGAA<br>GTGTCCTGGCAAAATGTCAGTGTTCCTGCCAACACCAGCCACATCAGGACCCCCGAA<br>GGCCTCTACCAGGTCACCAGTGTTCTGCGCCTCAAGCCTCAGCCTAGCAGAAACTTC<br>AGCTGCATGTTCTGGAATGCTCACATGAAGGAGCTGACTTCAGCCATCATTGACCCT<br>CTGAGTCGGATGGAACCCAAAGTCCCCAGAACGATCGATGTCGAGCCACTGGGCATG<br>*GAGAATGGGAACATTGCCAACTCACAGATCGCCGCCTCATCTGTGCGTGTGACCTTC*<br>*TTGGGTTTGCAGCATTGGGTCCCGGAGCTGGCCCGCCTGAACCGCGCAGGCATGGTC*<br>*AATGCCTGGACACCCAGCAGCAATGACGATAACCCCTGGATCCAGGTGAACCTGCTG*<br>*CGGAGGATGTGGGTAACAGGTGTGGTGACGCAGGGTGCCAGCCGCTTGGCCAGTCAT*<br>*GAGTACCTGAAGGCCTTCAAGGTGGCCTACAGCCTTAATGGACACGAATTCGATTTC*<br>*ATCCATGATGTTAATAAAAAACACAAGGAGTTTGTGGGTAACTGGAACAAAAACGCG*<br>*GTGCATGTCAACCTGTTTGAGACCCCTGTGGAGGCTCAGTACGTGAGATTGTACCCC*<br>*ACGAGCTGCCACACGGCCTGCACTCTGCGCTTTGAGCTACTGGGCTGTGAGCTGAAC*<br>*GGATGCGCAATCCCCTGGGCCTGAAGAATAACAGCATCCCTGACAAGCAGATCACG*<br>*GCCTCCAGCAGCTACAAGACCTGGGGCTTGCATCTCTTCAGCTGGAACCCCTCCTAT*<br>*GCACGGCTGGACAAGCAGGGCAACTTCAACGCCTGGGTTGCGGGGAGCTACGGTAAC*<br>*GATCAGTGGCTGCAGATCTTCCCTGGCAACTGGGACAACCACTCCCACAAGAAGAAC*<br>*TTGTTTGAGACGCCCATCCTGGCTCGCTATGTGCGCATCCTGCCTGTAGCCTGGCAC*<br>*AACCGCATCGCCCTGCGCCTGGAGCTGCTGGGCTGTTAG*<br>(SEQ ID NO: 293)<br>>Artificial Sequence; mPDL2-*C1C2*, Amino Acid<br>MLLLLPILNLSLQLHPVAALFTVTAPKEVYTVDVGSSVSLECDFDRRECTELEGIRA<br>SLQKVENDTSLQSERATLLEEQLPLGKALFHIPSVQVRDSGQYRCLVICGAAWDYKY<br>LTVKVKASYMRIDTRILEVPGTGEVQLTCQARGYPLAEVSWQNVSVPANTSHIRTPE<br>GLYQVTSVLRLKPQPSRNFSCMFWNAHMKELTSAIIDPLSRMEPKVPRTID*VEPLGM*<br>*ENGNIANSQIAASSVRVTFLGLQHWVPELARLNRAGMVNAWTPSSNDDNPWIQVNLL*<br>*RRMWVTGVVTQGASRLASHEYLKAFKVAYSLNGHEFDFIHDVNKKHKEFVGNWNKNA*<br>*VHVNLFETPVEAQYVRLYPTSCHTACTLRFELLGCELNGCANPLGLKNNSIPDKQIT*<br>*ASSSYKTWGLHLFSWNPSYARLDKQGNFNAWVAGSYGNDQWLQIFPGNWDNHSHKKN*<br>*LFETPILARYVRILPVAWHNRIALRLELLGC*<br>(SEQ ID NO: 294) |
| mPDL2-Fc-GPI | >Artificial Sequence; mPDL2-*Fc*-*GPI*, DNA<br>ATGCTGCTCCTGCTGCCGATACTGAACCTGAGCTTACAACTTCATCCTGTAGCAGCT<br>TTATTCACCGTGACAGCCCCTAAAGAAGTGTACACCGTAGACGTCGGCAGCAGTGTG<br>AGCCTGGAGTGCGATTTTGACCGCAGAGAATGCACTGAACTGGAAGGGATAAGAGCC<br>AGTTTGCAGAAGGTAGAAAATGATACGTCTCTGCAAAGTGAAAGAGCCACCCTGCTG<br>GAGGAGCAGCTGCCCCTGGGAAAGGCTTTGTTCCACATCCCTAGTGTCCAAGTGAGA<br>GATTCCGGGCAGTACCGTTGCCTGGTCATCTGCGGGGCCGCCTGGGACTACAAGTAC<br>CTGACGGTGAAAGTCAAAGCTTCTTACATGAGGATAGACACTAGGATCCTGGAGGTT<br>CCAGGTACAGGGGAGGTGCAGCTTACCTGCCAGGCTAGAGGTTATCCCCTAGCAGAA<br>GTGTCCTGGCAAAATGTCAGTGTTCCTGCCAACACCAGCCACATCAGGACCCCCGAA<br>GGCCTCTACCAGGTCACCAGTGTTCTGCGCCTCAAGCCTCAGCCTAGCAGAAACTTC<br>AGCTGCATGTTCTGGAATGCTCACATGAAGGAGCTGACTTCAGCCATCATTGACCCT<br>CTGAGTCGGATGGAACCCAAAGTCCCCAGAACGATCGAT<u>GACAAAACTCACACATGC</u><br><u>CCACCGTGCCCAGCACCTGAACTCCTGGGGGACCGTCAGTCTTCCTCTTCCCCCCA</u> |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | AAACCCAAGGACACCCTCATGATCTCCCGGACCCCTGAGGTCACATGCGTGGTGGTG<br>GACGTGAGCCACGAAGACCCTGAGGTCAAGTTCAACTGGTACGTGGACGGCGTGGAG<br>GTGCATAATGCCAAGACAAAGCCGCGGGAGGAGCAGTACAACAGCACGTACCGTGTG<br>GTCAGCGTCCTCACCGTCCTGCACCAGGACTGGCTGAATGGCAAGGAGTACAAGTGC<br>AAGGTCTCCAACAAAGCCCTCCCAGCCCCCATCGAGAAAACCATCTCCAAAGCCAAA<br>GGGCAGCCCCGAGAACCACAGGTGTACACCCTGCCCCCATCCCGGGAGGAGATGACC<br>AAGAACCAGGTCAGCCTGACCTGCCTGGTCAAAGGCTTCTATCCCAGCGACATCGCC<br>GTGGAGTGGGAGAGCAATGGGCAGCCGGAGAACAACTACAAGACCACGCCTCCCGTG<br>CTGGACTCCGACGGCTCCTTCTTCCTCTACAGCAAGCTCACCGTGGACAAGAGCAGG<br>TGGCAGCAGGGGAACGTCTTCTCATGCTCCGTGATGCACGAGGCTCTGCACAACCAC<br>TACACGCAGAAGAGCCTCTCCCTGTCTCCGGGTAAAATCGAT*CCAAATAAAGGAAGT<br>GGAACCACTTCAGGTACTACCCGTCTTCTATCTGGGCACACGTGTTTCACGTTGACA<br>GGTTTGCTTGGGACGCTAGTAACCATGGGCTTGCTGACTTAG*<br>(SEQ ID NO: 295)<br>>Artificial Sequence; **mPDL2-<u>Fc</u>-*GPI*, Amino Acid<br>MLLLLPILNLSLQLHPVAALFTVTAPKEVYTVDVGSSVSLECDFDRRECTELEGIRA<br>SLQKVENDTSLQSERATLLEEQLPLGKALFHIPSVQVRDSGQYRCLVICGAAWDYKY<br>LTVKVKASYMRIDTRILEVPGTGEVQLTCQARGYPLAEVSWQNVSVPANTSHIRTPE<br>GLYQVTSVLRLKPQPSRNFSCMFWNAHNKELTSAIIDPLSRMEPKVPRTIDDKTHTC<br>PPCPAPELLGGPSVFLFPPKPKDTLMISRTPEVTCVVVDVSHEDPEVKFNWYVDGVE<br>VHNAKTKPREEQYNSTYRVVSVLTVLHQDWLNGKEYKCKVSNKALPAPIEKTISKAK<br>GQPREPQVYTLPPSREEMTKNQVSLTCLVKGFYPSDIAVEWESNGQPENNYKTTPPV<br>LDSDGSFFLYSKLTVDKSRWQQGNVFSCSVMHEALHNHYTQKSLSLSPGKID*PNKGS<br>GTTSGTTRLLSGHTCFTLTGLLGTLVTMGLLT*<br>(SEQ ID NO: 296) |
| mPDL1-mFc-GPI | >Artificial Sequence; **mPDL1-<u>mFc</u>-*GPI*, DNA<br>ATGAGGATATTTGCTGGCATTATATTCACAGCCTGCTGTCACTTGCTACGGGCGTTT<br>ACTATCACGGCTCCAAAGGACTTGTACGTGGTGGAGTATGGCAGCAACGTCACGATG<br>GAGTGCAGATTCCCTGTAGAACGGGAGCTGGACCTGCTTGCGTTAGTGGTGTACTGG<br>GAAAAGGAAGATGAGCAAGTGATTCAGTTTGTGGCAGGAGAGGAGGACCTTAAGCCT<br>CAGCACAGCAACTTCAGGGGGAGAGCCTCGCTGCCAAAGGACCAGCTTTTGAAGGGA<br>AATGCTGCCCTTCAGATCACAGACGTCAAGCTGCAGGACGCAGGCGTTTACTGCTGC<br>ATAATCAGCTACGGTGGTGCGGACTACAAGCGAATCACGCTGAAAGTCAATGCCCCA<br>TACCGCAAAATCAACCAGAGAATTTCCGTGGATCCAGCCACTTCTGAGCATGAACTA<br>ATATGTCAGGCCGAGGGTTATCCAGAAGCTGAGGTAATCTGGACAAACAGTGACCAC<br>CAACCCGTGAGTGGGAAGAGAAGTGTCACCACTTCCCGGACAGAGGGGATGCTTCTC<br>AATGTGACCAGCAGTCTGAGGGTCAACGCCACAGCGAATGATGTTTTCTACTGTACG<br>TTTTGGAGATCACAGCCAGGGCAAAACCACACAGCGGAGCTGATCATCCCAGAACTG<br>CCTGCAACACATCCTCCACAGAACAGGACT*GGTTGTAAGCCTTGCATATGTACAGTC<br>CCAGAAGTATCATCTGTCTTCATCTTCCCCCCAAAGCCCAAGGATGTGCTCACCATT<br>ACTCTGACTCCTAAGGTCACGTGTGTTGTGGTAGACATCAGCAAGGATGATCCCGAG<br>GTCCAGTTCAGCTGGTTTGTAGATGATGTGGAGGTCACACAGCTCAGACGCAACCC<br>CGGGAGGAGCAGTTCAACAGCACTTTCCGCTCAGTCAGTGAACTTCCCATCATGCAC<br>CAGGACTGGCTCAATGGCAAGGAGTTCAAATGCAGGGTCAACAGTGCAGCTTTCCCT<br>GCCCCCATCGAGAAAACCATCTCCAAAACCAAAGGCAGACCGAAGGCTCCACAGGTG<br>TACACCATTCCACCTCCCAAGGAGCAGATGGCCAAGGATAAAGTCAGTCTGACCTGC<br>ATGATAACAGACTTCTTCCCTGAAGACATTACTGTGGAGTGGCAGTGGAATGGGCAG<br>CCAGCGGAGAACTACAAGAACACTCAGCCCATCATGGACACAGATGGCTCTTACTTC<br>GTCTACAGCAAGCTCAATGTGCAGAAGAGCAACTGGGAGGCAGGAAATACTTTCACC<br>TGCTCTGTGTTACATGAGGGCCTGCACAACCACCATACTGAGAAGAGCCTCTCCCAC<br>TCTCCTGGTAAACCAAATAAAGGAAGTGGAACCACTTCAGGTACTACCCGTCTTCTA<br>TCTGGGCACACGTGTTTCACGTTGACAGGTTTGCTTGGGACGCTAGTAACCATGGGC<br>TTGCTGACTTAG*<br>(SEQ ID NO: 297)<br>>Artificial Sequence; **mPDL1-<u>mFc</u>-*GPI*, Amino Acid<br>MRIFAGIIFTACCHLLRAFTITAPKDLYVVEYGSNVTMECRFPVERELDLLALVVYW<br>EKEDEQVIQFVAGEEDLKPQHSNFRGRASLPKDQLLKGNAALQITDVKLQDAGVYCC<br>IISYGGADYKRITLKVNAPYRKINQRISVDPATSEHELICQAEGYPEAEVIWTNSDH<br>QPVSGKRSVTTSRTEGMLLNVTSSLRVNATANDVFYCTFWRSQPGQNHTAELIIPEL<br>PATHPPQNRT*GCKPCICTVPEVSSVFIFPPKPKDVLTITLTPKVTCVVVDISKDDPE<br>VQFSWFVDDVEVHTAQTQPREEQFNSTFRSVSELPIMHQDWLNGKEFKCRVNSAAFP<br>APIEKTISKTKGRPKAPQVYTIPPPKEQMAKDKVSLTCMITDFFPEDITVEWQWNGQ<br>PAENYKNTQPIMDTDGSYFVYSKLNVQKSNWEAGNTFTCSVLHEGLHNHHTEKSLSH<br>SPGK*PNKGSGTTSGTTRLLSGHTCFTLTGLLGTLVTMGLLT<br>(SEQ ID NO: 298) |
| mPDL2-GPI | >Artificial Sequence; **mPDL2-*GPI*, DNA<br>ATGCTGCTCCTGCTGCCGATACTGAACCTGAGCTTACAACTTCATCCTGTAGCAGCT<br>TTATTCACCGTGACAGCCCCTAAAGAAGTGTACACCGTAGACGTCGGCAGCAGTGTG<br>AGCCTGGAGTGCGATTTTGACCGCAGAGAATGCACTGAACTGGAAGGGATAAGAGCC<br>AGTTTGCAGAAGGTAGAAAATGATACGTCTCTGCAAAGTGAAAGAGCCACCCTGCTG<br>GAGGAGCAGCTGCCCCTGGGAAAGGCTTTGTTCCACATCCCTAGTGTCCAAGTGAGA<br>GATTCCGGGCAGTACCGTTGCCTGGTCATCTGCGGGGCCGCCTGGGACTACAAGTAC<br>CTGACGGTGAAAGTCAAAGCTTCTTACATGAGGATAGACACTAGGATCCTGGAGGTT |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | CCAGGTACAGGGGAGGTGCAGCTTACCTGCCAGGCTAGAGGTTATCCCCTAGCAGAA<br>GTGTCCTGGCAAAATGTCAGTGTTCCTGCCAACACCAGCCACATCAGGACCCCCGAA<br>GGCCTCTACCAGGTCACCAGTGTTCTGCGCCTCAAGCCTCAGCCTAGCAGAAACTTC<br>AGCTGCATGTTCTGGAATGCTCACATGAAGGAGCTGACTTCAGCCATCATTGACCCT<br>CTGAGTCGGATGGAACCCAAAGTCCCCAGAACG*CCAAATAAAGGAAGTGGAACCACT<br>TCAGGTACTACCCGTCTTCTATCTGGGCACACGTGTTTCACGTTGACAGGTTTGCTT<br>GGGACGCTAGTAACCATGGGCTTGCTGACTTAG*<br>(SEQ ID NO: 299)<br>>Artificial Sequence; mPDL2-*GPI*, Amino Acid<br>MLLLLPILNLSLQLHPVAALFTVTAPKEVYTVDVGSSVSLECDFDRRECTELEGIRA<br>SLQKVENDTSLQSERATLLEEQLPLGKALFHIPSVQVRDSGQYRCLVICGAAWDYKY<br>LTVKVKASYMRIDTRILEVPGTGEVQLTCQARGYPLAEVSWQNVSVPANTSHIRTPE<br>GLYQVTSVLRLKPQPSRNFSCMFWNAHMKELTSAIIDPLSRMEPKVPRT*PNKGSGTT<br>SGTTRLLSGHTCFTLTGLLGTLVTMGLLT*<br>(SEQ ID NO: 300) |
| mPDL1-GPI-P2A-<br>mHVEM-GPI | >Artificial Sequence; mPDL1-*GPI*-<u>P2A</u>-mHVEM-*GPI*, DNA<br>ATGAGGATATTTGCTGGCATTATATTCACAGCCTGCTGTCACTTGCTACGGGCGTTT<br>ACTATCACGGCTCCAAAGGACTTGTACGTGGTGGAGTATGGCAGCAACGTCACGATG<br>GAGTGCAGATTCCCTGTAGAACGGGAGCTGGACCTGCTTGCGTTAGTGGTGTACTGG<br>GAAAAGGAAGATGAGCAAGTGATTCAGTTTGTGGCAGGAGAGGAGGACCTTAAGCCT<br>CAGCACAGCAACTTCAGGGGGAGAGCCTCGCTGCCAAAGGACCAGCTTTTGAAGGGA<br>AATGCTGCCCTTCAGATCACAGACGTCAAGCTGCAGGACGCAGGCGTTTACTGCTGC<br>ATAATCAGCTACGGTGGTGCGGACTACAAGCGAATCACGCTGAAAGTCAATGCCCCA<br>TACCGCAAAATCAACCAGAGAATTTCCGTGGATCCAGCCACTTCTGAGCATGAACTA<br>ATATGTCAGGCCGAGGGTTATCCAGAAGCTGAGGTAATCTGGACAAACAGTGACCAC<br>CAACCCGTGAGTGGGAAGAGAAGTGTCACCACTTCCCGGACAGAGGGGATGCTTCTC<br>AATGTGACCAGCAGTCTGAGGGTCAACGCCACAGCGAATGATGTTTTCTACTGTACG<br>TTTTGGAGATCACAGCCAGGGCAAAACCACACAGCGGAGCTGATCATCCCAGAACTG<br>CCTGCAACACATCCTCCACAGAACAGGACT*CCAAATAAAGGAAGTGGAACCACTTCA<br>GGTACTACCCGTCTTCTATCTGGGCACACGTGTTTCACGTTGACAGGTTTGCTTGGG<br>ACGCTAGTAACCATGGGCTTGCTGACTGGAAGCGGA*<u>GCTACTAACTTCAGCCTGCTG<br>AAGCAGGCTGGCGACGTGGAGGAGAACCCTGGACC</u>TATGGAACCTCTCCCAGGATGG<br>GGGTCGGCACCCTGGAGCCAGGCCCCTACAGACAACACCTTCAGGCTGGTGCCTTGT<br>GTCTTCCTTTTGAACTTGCTGCAGCGCATCTCTGCCCAGCCCTCATGCAGACAGGAG<br>GAGTTCCTTGTGGGAGACGAGTGCTGCCCCATGTGCAACCCAGGTTACCATGTGAAG<br>CAGGTCTGCAGTGAGCATACAGGCACAGTGTGTGCCCCCTGTCCCCCACAGACATAT<br>ACCGCCCATGCAAATGGCCTGAGCAAGTGTCTGCCCTGCGGAGTCTGTGATCCAGAC<br>ATGGGCCTGCTGACCTGGCAGGAGTGCTCCAGCTGGAAGGACACTGTGTGCAGATGC<br>ATCCCAGGCTACTTCTGTGAGAACCAGGATGGGAGCCACTGTTCCACATGCTTGCAG<br>CACACCACCTGCCCTCCAGGGCAGAGGGTAGAGAAGAGAGGGACTCACGACCAGGAC<br>ACTGTATGTGCTGACTGCCTAACAGGGACCTTCTCACTTGGAGGGACTCAGGAGGAA<br>TGCCTGCCCTGGACCAACTGCAGTGCATTTCAACAGGAAGTAAGACGTGGGACCAAC<br>AGCACAGACACCACCTGCTCCTCCCAG*CCAAATAAAGGAAGTGGAACCACTTCAGGT<br>ACTACCCGTCTTCTATCTGGGCACACGTGTTTCACGTTGACAGGTTTGCTTGGGACG<br>CTAGTAACCATGGGCTTGCTGACTTAG*<br>(SEQ ID NO: 301)<br>>Artificial Sequence; mPDL1-*GPI*-<u>P2A</u>-mHVEM-*GPI*, Amino Acid<br>MRIFAGIIFTACCHLLRAFTITAPKDLYVVEYGSNVTMECRFPVERELDLLALVVYW<br>EKEDEQVIQFVAGEEDLKPQHSNFRGRASLPKDQLLKGNAALQITDVKLQDAGVYCC<br>IISYGGADYKRITLKVNAPYRKINQRISVDPATSEHELICQAEGYPEAEVIWTNSDH<br>QPVSGKRSVTTSRTEGMLLNVTSSLRVNATANDVFYCTFWRSQPGQNHTAELIIPEL<br>PATHPPQNRT*PNKGSGTTSGTTRLLSGHTCFTLTGLLGTLVTMGLLTGSG*<u>ATNFSLL<br>KQAGDVEENPGPM</u>EPLPGWGSAPWSQAPTDNTFRLVPCVFLLNLLQRISAQPSCRQE<br>EFLVGDECCPMCNPGYHVKQVCSEHTGTVCAPCPPQTYTAHANGLSKCLPCGVCDPD<br>MGLLTWQECSSWKDTVCRCIPGYFCENQDGSHCSTCLQHTTCPPGQRVEKRGTHDQD<br>TVCADCLTGTFSLGGTQEECLPWTNCSAFQQEVRRGTNSTDTTCSSQ*PNKGSGTTSG<br>TTRLLSGHTCFTLTGLLGTLVTMGLLT*<br>(SEQ ID NO: 302) |
| hPDL1-ADAM10 | >Artificial Sequence; hPDL1-*ADAM10*, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTGAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCAAGAGAGGAGAAGCTT<br>TTCAATGTGACCAGCACACTGAGAATCAACACAACAACTAATGAGATTTTCTACTGC<br>ACTTTTAGGAGATTAGATCCTGAGGAAAACCATACAGCTGAATTGGTCATCCCAGAA<br>CTACCTCTGGCACATCCTCCAAATGAAAGG*TGTGGAAATGGAATGGTAGAACAAGGT<br>GAAGAATGTGATTGTGGCTATAGTGACCAGTGTAAAGATGAATGCTGCTTCGATGCA* |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | AATCAACCAGAGGGAAGAAAATGCAAACTGAAACCTGGGAAACAGTGCAGTCCAAGT<br>CAAGGTCCTTGTTGTACAGCACAGTGTGCATTCAAGTCAAAGTCTGAGAAGTGTCGG<br>GATGATTCAGACTGTGCAAGGGAAGGAATATGTAATGGCTTCACAGCTCTCTGCCCA<br>GCATCTGACCCTAAACCAAACTTCACAGACTGTAATAGGCATACACAAGTGTGCATT<br>AATGGGCAATGTGCAGGTTCTATCTGTGAGAAATATGGCTTAGAGGAGTGTACGTGT<br>GCCAGTTCTGATGGCAAAGATGATAAAGAATTATGCCATGTATGCTGTATGAAGAAA<br>ATGGACCCATCAACTTGTGCCAGTACAGGGTCTGTGCAGTGGAGTAGGCACTTCAGT<br>GGTCGAACCATCACCCTGCAACCTGGATCCCCTTGCAACGATTTTAGAGGTTACTGT<br>GATGTTTTCATGCGGTGCAGATTAGTAGATGCTGATGGTCCTCTAGCTAGGCTTAAA<br>AAAGCAATTTTTAGTCCAGAGCTCTATGAAAACATTGCTGAATGGATTGTGGCTCAT<br>TGGTGGGCAGTATTACTTATGGGAATTGCTCTGATCATGCTAATGGCTGGATTTATT<br>AAGATATGCAGTGTTaATACTCCAAGTAGTAATCCAAAGTTGCCTCCTCCTAAACCA<br>CTTCCAGGCACTTTAAAGAGGAGGAGACCTCCACAGCCCATTCAGCAACCCCAGCGT<br>CAGCGGCCCCGAGAGAGTTATCAAATGGGACACATGAGACGCTAA<br>(SEQ ID NO: 303)<br>>Artificial Sequence; hPDL1-ADAM10, Amino Acid<br>MRIFAVFIFMTYWHLLNAFTVTVPKDLYVVEYGSNMTIECKEPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPE<br>LPLAHPPNERCGNGMVEQGEECDCGYSDQCKDECCFDANQPEGRKCKLKPGKQCSPS<br>QGPCCTAQCAFKSKSEKCRDDSDCAREGICNGFTALCPASDPKPNFTDCNRHTQVCI<br>NGQCAGSICEKYGLEECTCASSDGKDDEELCHVCCMKKMDPSTCASTGSVQWSRHFS<br>GRTITLQPGSPCNDFRGYCDVFMRCRLVDADGPLARLKKAIFSPELYENIAEWIVAH<br>WWAVLLMGIALIMLMAGFIKICSVHTPSSNPKLPPPKPLPGTLKRRRPPQPIQQPQR<br>QRPRESYQMGHMRR<br>(SEQ ID NO: 304) |
| hPDL1-4Fc-<br>CD9tm2 | >Artificial Sequence; hPDL1-<u>4Fc</u>-CD9tm2, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTGAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCCAAGAGAGAGGAGAAGCTT<br>TTCAATGTGACCAGCACACTGAGAATCAACACAACAACTAATGAGATTTTCTACTGC<br>ACTTTTAGGAGATTAGATCCTGAGGAAAACCATACAGCTGAATTGGTCATCCCAGAA<br>CTACCTCTGGCACATCCTCCAAATGAAAGG<u>GAGTCCAAATATGGTCCCCCATGCCCA</u><br><u>TCATGCCCAGCACCTGAGTTCCTGGGGGGACCATCAGTCTTCCTGTTCCCCCCAAAA</u><br><u>CCCAAGGACACTCTCATGATCTCCCGGACCCCTGAGGTCACGTGCGTGGTGGTGGAC</u><br><u>GTGAGCCAGGAAGACCCCGAGGTCCAGTTCAACTGGTACGTGGATGGCGTGGAGGTG</u><br><u>CATAATGCCAAGACAAAGCCGCGGGAGGAGCAGTTCAACAGCACGTACCGTGTGGTC</u><br><u>AGGGTCCTCACCGTCCTGCACCAGGACTGGCTGAACGGTAAGGAGTACAAGTGCAAG</u><br><u>GTCTCCAACAAAGGCCTCCCGTCCTCCATCGAGAAAACCATCTCCAAAGCCAAAGGG</u><br><u>CAGCCCCGAGAGCCACAGGTGTACACCCTGCCCCCATCCCAGGAGGAGATGACCAAG</u><br><u>AACCAGGTCAGCCTGACCTGCCTGGTCAAAGGCTTCTACCCCAGCGACATCGCCGTG</u><br><u>GAGTGGGAGAGCAATGGGCAGCCGGAGGACAACTACAAGACCACGCCTCCCGTGCTG</u><br><u>GACTCCGACGGCTCCTTCTTCCTCTACAGCAGGCTAACCGTGGACAAGAGCAGGTGG</u><br><u>CAGGAGGGGAATGTCTTCTCATGCTCCGTGATGCATGAGGCTCTGCACAACCACTAC</u><br><u>ACACAGAAGAGCCTCTCCCTGTCTCCGGGTAAA</u>TTCTACACAGGAGTCTATATTCTG<br>ATCGGAGCCGGCGCCCTCATGATGCTGGTGGGCTTCCTGGGCTGCTGCGGGGCTGTG<br>CAGGAGTCCCAGTGC<br>(SEQ ID NO: 305)<br>>Artificial Sequence; hPDL1-<u>4Fc</u>-CD9tm2, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPE<br>LPLAHPPNER<u>ESKYGPPCPSCPAPEFLGGPSVFLFPPKPKDTLMISRTPEVTCVVVD</u><br><u>VSQEDPEVQFNWYVDGVEVHNAKTKPREEQFNSTYRVVRVLTVLHQDWLNGKEYKCK</u><br><u>VSNKGLPSSIEKTISKAKGQPREPQVYTLPPSQEEMTKNQVSLTCLVKGFYPSDIAV</u><br><u>EWESNGQPEDNYKTTPPVLDSDGSFFLYSRLTVDKSRWQEGNVFSCSVMHEALHNHY</u><br><u>TQKSLSLSPGK</u>FYTGVYILIGAGALMMLVGFLGCCGAVQESQCVIM<br>(SEQ ID NO: 306) |
| hPDL1-4Fc-<br>CD9tm2-<br>modified KRas | >Artificial Sequence; hPDL1-<u>4Fc</u>-CD9tm2-<u>KRAS</u>, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTGAAGGACCAGCTCTCCCTGGGA |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCCAAGAGAGGAGAAGCTT<br>TTCAATGTGACCAGCACACTGAGAATCAACACAACAACTAATGAGATTTTCTACTGC<br>ACTTTTAGGAGATTAGATCCTGAGGAAAACCATACAGCTGAATTGGTCATCCCAGAA<br>CTACCTCTGGCACATCCTCCAAATGAAAGG<u>GAGTCCAAATATGGTCCCCCATGCCCA</u><br><u>TCATGCCCAGCACCTGAGTTCCTGGGGGGACCATCAGTCTTCCTGTTCCCCCCAAAA</u><br><u>CCCAAGGACACTCTCATGATCTCCCGGACCCCTGAGGTCACGTGCGTGGTGGTGGAC</u><br><u>GTGAGCCAGGAAGACCCCGAGGTCCAGTTCAACTGGTACGTGGATGGCGTGGAGGTG</u><br><u>CATAATGCCAAGACAAAGCCGCGGGAGGAGCAGTTCAACAGCACGTACCGTGTGGTC</u><br><u>AGGGTCCTCACCGTCCTGCACCAGGACTGGCTGAACGGTAAGGAGTACAAGTGCAAG</u><br><u>GTCTCCAACAAAGGCCTCCCGTCCTCCATCGAGAAAACCATCTCCAAAGCCAAAGGG</u><br><u>CAGCCCCGAGAGCCACAGGTGTACACCCTGCCCCCATCCCAGGAGGAGATGACCAAG</u><br><u>AACCAGGTCAGCCTGACCTGCCTGGTCAAAGGCTTCTACCCCAGCGACATCGCCGTG</u><br><u>GAGTGGGAGAGCAATGGGCAGCCGGAGGACAACTACAAGACCACGCCTCCCGTGCTG</u><br><u>GACTCCGACGGCTCCTTCTTCCTCTACAGCAGGCTAACCGTGGACAAGAGCAGGTGG</u><br><u>CAGGAGGGGAATGTCTTCTCATGCTCCGTGATGCATGAGGCTCTGCACAACCACTAC</u><br><u>ACACAGAAGAGCCTCTCCCTGTCTCCGGGTAAA</u>TTCTACACAGGAGTCTATATTCTG<br>ATCGGAGCCGGCGCCCTCATGATGCTGGTGGGCTTCCTGGGCTGCTGCGGGGCTGTG<br>CAGGAGTCCCAGTGC<u>AAAAAGAAGAAAAAGAAGAAGAAGACAAAGTGTGTAATTATG</u><br><u>TAA</u><br>(SEQ ID NO: 307)<br>>Artificial Sequence; hPDL1-<u>4Fc</u>-*CD9tm2*-<u>*KRAS*</u>, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPE<br>LPLAHPPNER<u>ESKYGPPCPSCPAPEFLGGPSVFLFPPKPKDTLMISRTPEVTCVVVD</u><br><u>VSQEDPEVQFNWYVDGVEVHNAKTKPREEQFNSTYRVVRVLTVLHQDWLNGKEYKCK</u><br><u>VSNKGLPSSIEKTISKAKGQPREPQVYTLPPSQEEMTKNQVSLTCLVKGFYPSDIAV</u><br><u>EWESNGQPEDNYKTTPPVLDSDGSFFLYSRLTVDKSRWQEGNVFSCSVMHEALHNHY</u><br><u>TQKSLSLSPGK</u>*FYTGVYILIGAGALMMLVGFLGCCGAVQESQC*<u>KKKKKKKTKCVIM</u><br>(SEQ ID NO: 308) |
| hPDL1-<u>Fc</u>-<br>CD9tm2 | >Artificial Sequence; hPDL1-<u>Fc</u>-*CD9tm2*, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTGAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTGGACAAGCAGTGAC<br>CATCAAGTCCTGAGTGGTAAGACCACCACCACCAATTCCAAGAGAGGAGAAGCTT<br>TTCAATGTGACCAGCACACTGAGAATCAACACAACAACTAATGAGATTTTCTACTGC<br>ACTTTTAGGAGATTAGATCCTGAGGAAAACCATACAGCTGAATTGGTCATCCCAGAA<br>CTACCTCTGGCACATCCTCCAAATGAAAGGATCGAT<u>GACAAAACTCACACATGCCCA</u><br><u>CCGTGCCCAGCACCTGAACTCCTGGGGGGACCGTCAGTCTTCCTCTTCCCCCCAAAA</u><br><u>CCCAAGGACACCCTCATGATCTCCCGGACCCCTGAGGTCACATGCGTGGTGGTGGAC</u><br><u>GTGAGCCACGAAGACCCTGAGGTCAAGTTCAACTGGTACGTGGACGGCGTGGAGGTG</u><br><u>CATAATGCCAAGACAAAGCCGCGGGAGGAGCAGTACAACAGCACGTACCGTGTGGTC</u><br><u>AGCGTCCTCACCGTCCTGCACCAGGACTGGCTGAATGGCAAGGAGTACAAGTGCAAG</u><br><u>GTCTCCAACAAAGCCCTCCCAGCCCCCATCGAGAAAACCATCTCCAAAGCCAAAGGG</u><br><u>CAGCCCCGAGAACCACAGGTGTACACCCTGCCCCCATCCCGGGAGGAGATGACCAAG</u><br><u>AACCAGGTCAGCCTGACCTGCCTGGTCAAAGGCTTCTATCCCAGCGACATCGCCGTG</u><br><u>GAGTGGGAGAGCAATGGGCAGCCGGAGAACAACTACAAGACCACGCCTCCCGTGCTG</u><br><u>GACTCCGACGGCTCCTTCTTCCTCTACAGCAAGCTCACCGTGGACAAGAGCAGGTGG</u><br><u>CAGCAGGGGAACGTCTTCTCATGCTCCGTGATGCACGAGGCTCTGCACAACCACTAC</u><br><u>ACGCAGAAGAGCCTCTCCCTGTCTCCGGGTAAA</u>ATCGATTTCTACACAGGAGTCTAT<br>ATTCTGATCGGAGCCGGCGCCCTCATGATGCTGGTGGGCTTCCTGGGCTGCTGCGGG<br>GCTGTGCAGGAGTCCCAGTGCGTAATTATGTAA<br>(SEQ ID NO: 309)<br>>Artificial Sequence; hPDL1-<u>Fc</u>-*CD9tm2*, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPE<br>LPLAHPPNER<u>IDDKTHTCPPCPAPELLGGPSVFLFPPKPKDTLMISRTPEVTCVVVD</u><br><u>VSHEDPEVKFNWYVDGVEVHNAKTKPREEQYNSTYRVVSVLTVLHQDWLNGKEYKCK</u> |

TABLE 4-continued

Full Length Constructs

Fusion Polypeptide | Nucleic Acid Sequence (SEQ ID NO:)
Amino Acid Sequence (SEQ ID NO:)

| | |
|---|---|
| | VSNKALPAPIEKTISKAKGQPREPQVYTLPPSREEMTKNQVSLTCLVKGFYPSDIAV<br>EWESNGQPENNYKTTPPVLDSDGSFFLYSKLTVDKSRWQQGNVFSCSVMHEALHNHY<br>TQKSLSLSPGKI*DFYTGVYILIGAGALMMLVGFLGCCGAVQESQCVIM*<br>(SEQ ID NO: 310) |
| hPDL1-Fc-<br>CD9tm2-<br>modified KRAS | >Artificial Sequence; hPDL1-Fc-*CD9tm2*-<u>KRAS</u>, DNA<br>ATGAGGATATTTGCTGTCTTTATATTCATGACCTACTGGCATTTGCTGAACGCATTT<br>ACTGTCACGGTTCCCAAGGACCTATATGTGGTAGAGTATGGTAGCAATATGACAATT<br>GAATGCAAATTCCCAGTAGAAAAACAATTAGACCTGGCTGCACTAATTGTCTATTGG<br>GAAATGGAGGATAAGAACATTATTCAATTTGTGCATGGAGAGGAAGACCTGAAGGTT<br>CAGCATAGTAGCTACAGACAGAGGGCCCGGCTGTTGAAGGACCAGCTCTCCCTGGGA<br>AATGCTGCACTTCAGATCACAGATGTGAAATTGCAGGATGCAGGGGTGTACCGCTGC<br>ATGATCAGCTATGGTGGTGCCGACTACAAGCGAATTACTGTGAAAGTCAATGCCCCA<br>TACAACAAAATCAACCAAAGAATTTTGGTTGTGGATCCAGTCACCTCTGAACATGAA<br>CTGACATGTCAGGCTGAGGGCTACCCCAAGGCCGAAGTCATCTCTGGAAGCAGTGAC<br>CATCAAGTCCTGAGTGGTAAGACCACCACCACCAATTCCAAGAGAGAGGAGAAGCTT<br>TTCAATGTGACCAGCACACTGAGAATCAACACAACAACTAATGAGATTTTCTACTGC<br>ACTTTTAGGAGATTAGATCCTGAGGAAAACCATACAGCTGAATTGGTCATCCCAGAA<br>CTACCTCTGGCACATCCTCCAAATGAAAGGATCGATGA<u>CAAAACTCACACATGCCCA</u><br><u>CCGTGCCCAGCACCTGAACTCCTGGGGGGACCGTCAGTCTTCCTCTTCCCCCCAAAA</u><br><u>CCCAAGGACACCCTCATGATCTCCCGGACCCCTGAGGTCACATGCGTGGTGGTGGAC</u><br><u>GTGAGCCACGAAGACCCTGAGGTCAAGTTCAACTGGTACGTGGACGGCGTGGAGGTG</u><br><u>CATAATGCCAAGACAAAGCCGCGGGAGGAGCAGTACAACAGCACGTACCGTGTGGTC</u><br><u>AGCGTCCTCACCGTCCTGCACCAGGACTGGCTGAATGGCAAGGAGTACAAGTGCAAG</u><br><u>GTCTCCAACAAAGCCCTCCCAGCCCCCATCGAGAAAACCATCTCCAAAGCCAAAGGG</u><br><u>CAGCCCCGAGAACCACAGGTGTACACCCTGCCCCCATCCCGGGAGGAGATGACCAAG</u><br><u>AACCAGGTCAGCCTGACCTGCCTGGTCAAAGGCTTCTATCCCAGCGACATCGCCGTG</u><br><u>GAGTGGGAGAGCAATGGGCAGCCGGAGAACAACTACAAGACCACGCCTCCCGTGCTG</u><br><u>GACTCCGACGGCTCCTTCTTCCTCTACAGCAAGCTCACCGTGGACAAGAGCAGGTGG</u><br><u>CAGCAGGGGAACGTCTTCTCATGCTCCGTGATGCACGAGGCTCTGCACAACCACTAC</u><br><u>ACGCAGAAGAGCCTCTCCCTGTCTCCGGGTAAA</u>ATCGATTTCTACACAGGAGTCTAT<br>ATTCTGATCGGAGCCGGCGCCCTCATGATGCTGGTGGGCTTCCTGGGCTGCTGCGGG<br>GCTGTGCAGGAGTCCCAGTGC<u>AAAAAAGAAGAAAAAGAAGAAGAAGACAAAGTGTGTA</u><br><u>ATTATGTAA</u> (SEQ ID NO: 311)<br>>Artificial Sequence; hPDL1-Fc-*CD9tm2*-<u>KRAS</u>, Amino Acid<br>MRIFAVFIFMTYWHLLNAFTVTVPKDLYVVEYGSNMTIECKFPVEKQLDLAALIVYW<br>EMEDKNIIQFVHGEEDLKVQHSSYRQRARLLKDQLSLGNAALQITDVKLQDAGVYRC<br>MISYGGADYKRITVKVNAPYNKINQRILVVDPVTSEHELTCQAEGYPKAEVIWTSSD<br>HQVLSGKTTTTNSKREEKLFNVTSTLRINTTTNEIFYCTFRRLDPEENHTAELVIPE<br>LPLAHPPNERI<u>DDKTHTCPPCPAPELLGGPSVFLFPPKPKDTLMISRTPEVTCVVVD</u><br><u>VSHEDPEVKFNWYVDGVEVHNAKTKPREEQYNSTYRVVSVLTVLHQDWLNGKEYKCK</u><br><u>VSNKALPAPIEKTISKAKGQPREPQVYTLPPSREEMTKNQVSLTCLVKGFYPSDIAV</u><br><u>EWESNGQPENNYKTTPPVLDSDGSFFLYSKLTVDKSRWQQGNVFSCSVMHEALHNHY</u><br><u>TQKSLSLSPGKI</u>*DFYTGVYILIGAGALMMLVGFLGCCGAVQESQC*<u>KKKKKKKKTKCV</u><br><u>IM</u><br>(SEQ ID NO: 312) |
| mPDL1-mFc-<br>CD9tm2 | >Artificial Sequence; mPDL1-mFc-*CD9tm2*, DNA<br>ATGAGGATATTTGCTGGCATTATATTCACAGCCTGCTGTCACTTGCTACGGGCGTTT<br>ACTATCACGGCTCCAAAGGACTTGTACGTGGTGGAGTATGGCAGCAACGTCACGATG<br>GAGTGCAGATTCCCTGTAGAACGGGAGCTGGACCTGCTTGCGTTAGTGGTGTACTGG<br>GAAAAGGAAGATGAGCAAGTGATTCAGTTTGTGGCAGGAGAGGAGGACCTTAAGCCT<br>CAGCACAGCAACTTCAGGGGAGAGCCTCGCTGCCAAAGGACCAGCTTTTGAAGGGA<br>AATGCTGCCCTTCAGATCACAGACGTCAAGCTGCAGGACGCAGGCGTTTACTGCTGC<br>ATAATCAGCTACGGTGGTGCGGACTACAAGCGAATCACGCTGAAAGTCAATGCCCCA<br>TACCGCAAAATCAACCAGAGAATTCCGTGGATCCAGCCACTTCTGAGCATGAACTA<br>ATATGTCAGGCCGAGGGTTATCCAGAAGCTGAGGTAATCTGGACAAACAGTGACCAC<br>CAACCCGTGAGTGGGAAGAGAAGTGTCACCACTTCCCGGACAGAGGGGATGCTTCTC<br>AATGTGACCAGCAGTCTGAGGGTCAACGCCACAGCGAATGATGTTTTCTACTGTACG<br>TTTTGGAGATCACAGCCAGGGCAAAACCACACAGCGGAGCTGATCATCCCAGAACTG<br>CCTGCAACACATCCTCCACAGAACAGGACT<u>GGTTGTAAGCCTTGCATATGTACAGTC</u><br><u>CCAGAAGTATCATCTGTCTTCATCTTCCCCCCAAAGCCCAAGGATGTGCTCACCATT</u><br><u>ACTCTGACTCCTAAGGTCACGTGTGTTGTGGTAGACATCAGCAAGGATGATCCCGAG</u><br><u>GTCCAGTTCAGCTGGTTTGTAGATGATGTGGAGGTGCACACAGCTCAGACGCAACCC</u><br><u>CGGGAGGAGCAGTTCAACAGCACTTTCCGCTCAGTCAGTGAACTTCCCATCATGCAC</u><br><u>CAGGACTGGCTCAATGGCAAGGAGTTCAAATGCAGGGTCAACAGTGCAGCTTTCCCT</u><br><u>GCCCCCATCGAGAAAACCATCTCCAAAACCAAAGGCAGACCGAAGGCTCCACAGGTG</u><br><u>TACACCATTCCACCTCCCAAGGAGCAGATGGCCAAGGATAAAGTCAGTCTGACCTGC</u><br><u>ATGATAACAGACTTCTTCCCTGAAGACATTACTGTGGAGTGGCAGTGGAATGGGCAG</u><br><u>CCAGCGGAGAACTACAAGAACACTCAGCCCATCATGGACACAGATGGCTCTTACTTC</u> |

TABLE 4-continued

Full Length Constructs

| Fusion Polypeptide | Nucleic Acid Sequence (SEQ ID NO:)<br>Amino Acid Sequence (SEQ ID NO:) |
|---|---|
| | GTCTACAGCAAGCTCAATGTGCAGAAGAGCAACTGGGAGGCAGGAAATACTTTCACC<br>TGCTCTGTGTTACATGAGGGCCTGCACAACCACCATACTGAGAAGAGCCTCTCCCAC<br>TCTCCTGGTAAA*TTCTACACAGGAGTCTATATTCTGATCGGAGCCGGCGCCCTCATG*<br>*ATGCTGGTGGGCTTCCTGGGCTGCTGCGGGGCTGTGCAGGAGTCCCAGTGCGTAATT*<br>*ATGTAA*<br>(SEQ ID NO: 313)<br>>Artificial Sequence; mPDL1-mFc-*CD9tm2*, Amino Acid<br>MRIFAGIIFTACCHLLRAFTITAPKDLYVVEYGSNVTMECRFPVERELDLLALVVYW<br>EKEDEQVIQFVAGEEDLKPQHSNFRGRASLPKDQLLKGNAALQITDVKLQDAGVYCC<br>IISYGGADYKRITLKVNAPYRKINQRISVDPATSEHELICQAEGYPEAEVIWTNSDH<br>QPVSGKRSVTTSRTEGMLLNVTSSLRVNATANDVFYCTFWRSQPGQNHTAELIIPEL<br>PATHPPQNRTGCKPCICTVPEVSSVFIFPPKPKDVLTITLTPKVTCVVVDISKDDPE<br>VQFSWFVDDVEVHTAQTQPREEQFNSTFRSVSELPIMHQDWLNGKEFKCRVNSAAFP<br>APIEKTISKTKGRPKAPQVYTIPPPKEQMAKDKVSLTCMITDFFPEDITVEWQWNGQ<br>PAENYKNTQPIMDTDGSYFVYSKLNVQKSNWEAGNTFTCSVLHEGLHNHHTEKSLSH<br>SPGKP*FYTGVYILIGAGALMMLVGFLGCCGAVQESQCVIM*<br>(SEQ ID NO: 314) |
| mPDL1-mFc-<br>CD9tm2-<br>modified KRAS | >Artificial Sequence; mPDL1-mFc-*CD9tm2*-<u>KRAS</u>, DNA<br>ATGAGGATATTTGCTGGCATTATATTCACAGCCTGCTGTCACTTGCTACGGGCGTTT<br>ACTATCACGGCTCCAAAGGACTTGTACGTGGTGGAGTATGGCAGCAACGTCACGATG<br>GAGTGCAGATTCCCTGTAGAACGGGAGCTGGACCTGCTTGCGTTAGTGGTGTACTGG<br>GAAAAGGAAGATGAGCAAGTGATTCAGTTTGTGGCAGGAGAGGAGGACCTTAAGCCT<br>CAGCACAGCAACTTCAGGGGAGAGCCTCGCTGCCAAAGGACCAGCTTTTGAAGGGA<br>AATGCTGCCCTTCAGATCACAGACGTCAAGCTGCAGGACGCAGGCGTTTACTGCTGC<br>ATAATCAGCTACGGTGGTGCGGACTACAAGCGAATCACGCTGAAAGTCAATGCCCCA<br>TACCGCAAAATCAACCAGAGAATTTCCGTGGATCCAGCCACTTCTGAGCATGAACTA<br>ATATGTCAGGCCGAGGGTTATCCAGAAGCTGAGGTAATCTGGACAAACAGTGACCAC<br>CAACCCGTGAGTGGGAAGAGAAGTGTCACCACTTCCCGGACAGAGGGGATGCTTCTC<br>AATGTGACCAGCAGTCTGAGGGTCAACGCCACAGCGAATGATGTTTTCTACTGTACG<br>TTTTGGAGATCACAGCCAGGGCAAAACCACACAGCGGAGCTGATCATCCCAGAACTG<br>CCTGCAACACATCCTCCACAGAACAGGACT<u>GGTTGTAAGCCTTGCATATGTACAGTC</u><br><u>CCAGAAGTATCATCTGTCTTCATCTTCCCCCCAAAGCCCAAGGATGTGCTCACCATT</u><br><u>ACTCTGACTCCTAAGGTCACGTGTGTTGTGGTAGACATCAGCAAGGATGATCCCGAG</u><br><u>GTCCAGTTCAGCTGGTTTGTAGATGATGTGGAGGTGCACACAGCTCAGACGCAACCC</u><br><u>CGGGAGGAGCAGTTCAACAGCACTTTCCGCTCAGTCAGTGAACTTCCCATCATGCAC</u><br><u>CAGGACTGGCTCAATGGCAAGGAGTTCAAATGCAGGGTCAACAGTGCAGCTTTCCCT</u><br><u>GCCCCCATCGAGAAAACCATCTCCAAAACCAAAGGCAGACCGAAGGCTCCACAGGTG</u><br><u>TACACCATTCCACCTCCCAAGGAGCAGATGGCCAAGGATAAAGTCAGTCTGACCTGC</u><br><u>ATGATAACAGACTTCTTCCCTGAAGACATTACTGTGGAGTGGCAGTGGAATGGGCAG</u><br><u>CCAGCGGAGAACTACAAGAACACTCAGCCCATCATGGACACAGATGGCTCTTACTTC</u><br><u>GTCTACAGCAAGCTCAATGTGCAGAAGAGCAACTGGGAGGCAGGAAATACTTTCACC</u><br><u>TGCTCTGTGTTACATGAGGGCCTGCACAACCACCATACTGAGAAGAGCCTCTCCCAC</u><br><u>TCTCCTGGTAAA</u>*TTCTACACAGGAGTCTATATTCTGATCGGAGCCGGCGCCCTCATG*<br>*ATGCTGGTGGGCTTCCTGGGCTGCTGCGGGGCTGTGCAGGAGTCCCAGTGC*<u>AAAAAG</u><br><u>AAGAAAAAGAAGAAGAAGACAAAGTGTGTAATTATGTAA</u><br>(SEQ ID NO: 315)<br>>Artificial Sequence; mPDL1-mFc-*CD9tm2*-<u>KRAS</u>, Amino Acid<br>MRIFAGIIFTACCHLLRAFTITAPEDLYVVEYGSNVTMECRFPVERELDLLALVVYW<br>EKEDEQVIQFVAGEEDLKPQHSNFRGRASLPKDQLLKGNAALQITDVKLQDAGVYCC<br>IISYGGADYKRITLKVNAPYRKINQRISVDPATSEHELICQAEGYPEAEVIWTNSDH<br>QPVSGKRSVTTSRTEGMLLNVTSSLRVNATANDVFYCTFWRSQPGQNHTAELIIPEL<br>PATHPPQNRTGCKPCICTVPEVSSVFIFPPKPKDVLTITLTPKVTCVVVDISKDDPE<br>VQFSWFVDDVEVHTAQTQPREEQFNSTFRSVSELPIMHQDWLNGKEFKCRVNSAAFP<br>APIEKTISKTKGRPKAPQVYTIPPPKEQMAKDKVSLTCMITDFFPEDITVEWQWNGQ<br>PAENYKNTQPIMDTDGSYFVYSKLNVQKSNWEAGNTFTCSVLHEGLHNHHTEKSLSH<br>SPGKF*YTGVYILIGAGALMMLVGFLGCCGAVQESQC*<u>KKKKKKKKTKCVIM</u><br>(SEQ ID NO: 316) |

In some embodiments of any of the aspects, the fusion polypeptides provided herein comprise two or more POI domains. The specific combinations of POI domains can be used to regulate inflammatory immune responses. Non-limiting examples of additive and synergistic combinations of POIs that can modulate inflammatory signaling pathways are provided in Table 5 (below).

TABLE 5

Exemplary POI combinations and combined targets for modulating inflammation.

| POIs (LIGANDS) | COMBINED TARGETS | PUTATIVE ADDITIVE or SYNERGISTIC MOA |
|---|---|---|
| PD-L1 or PD-L2 HVEM | PD-1 BTLA | Differential use of Shp phosphatases. BTLA inhibits both TCR and CD28 phosphorylation (via Shp1) while PD-1 inhibits CD28 phosphorylation (via Shp2). |
| PD-L1 or PD-L2 FGL1 | PD-1 LAG-3 | LAG-3 exerts differential inhibitory impacts on various types of lymphocytes and shows synergy with PD-1 to inhibit immune responses. |
| PD-L1 or PD-L2 CEACAM-1 or GAL9 | PD-1 TIM-3 | PD-1 and Tim-3 have non-redundant downstream signaling mechanisms. |
| PD-L1 or PD-L2 CD155 | PD-1 TIGIT | Differential use of Shp phosphatases. Non-redundantly regulate T cell responses. |
| PD-L1 or PD-L2 VSIG3 | PD-1 VISTA | PD-1 and VISTA non-redundantly regulate T cell responses. VISTA contains cytosolic SH3 binding domains for adapter proteins. |
| CEACAM-1 or GAL9 CD155 | TIM-3 TIGIT | TIGIT and TIM-3 have non-redundant downstream signaling mechanisms. |
| PD-L1 or PD-L2 FGL1 CEACAM-1 or GAL9 | PD-1 LAG-3 TIM-3 | PD-1, LAG-3 and TIM-3 have non-redundant downstream signaling mechanisms. |

Methods of Preparing Extracellular Vesicle Compositions

In another aspect, provided herein is a method of preparing an engineered extracellular vesicle provided herein. Generally, the method comprises providing a population of cells expressing a vector construct encoding one or more sticky binder (vesicle targeting domain) and one or more signaling domains (POI domain).

The EVs provided herein can be isolated and purified form any biological source, e.g., cells. The cells that produce the engineered EVs provided herein can be from any viable non-human source or organism. Usually the organism is an animal, vertebrate, or mammal. In some embodiments, the cell described herein is from a human. The cells described herein can be from any tissue isolated from an organism by methods known in the art. The scientific literature provides guidance for one of ordinary skill in the art to isolate, prepare, and culture cells as necessary for use in the compositions and methods described herein. One of skill in the art can appreciate that the cell source of the EVs may alter the cellular protein expression and the native or endogenous cargo within the EV. It is contemplated herein that this can be leveraged for therapeutic effect depending on the disease or disorder being treated.

In some embodiments, the population of cells has been altered by exposure to environmental conditions (e.g., hypoxia), small molecule addition, presence/absence of exogenous factors (e.g., growth factors, cytokines) at the time, or substantially contemporaneous with, isolating the plurality of artificial synapses in a manner altering the regulatory state of the cell. In various embodiments, the cells are HEK 293 cells, MSCs, PER.C, fibrosarcoma HT-1080 or HuH7 cell lines.

The method comprises providing a population of cells and culturing the cells in serum-free or un-concentrated conditioned medium. This includes, for example, artificial synapses secreted into media as conditioned by a population of cells in culture, further including cell lines capable of serial passaging. In certain embodiments, the cells in culture are grown to 10, 20, 30, 40, 50, 60, 70, 80, 90, or 90% or more confluency when artificial synapses (engineered EVs) are isolated.

The methods provided herein further comprise contacting the cells provided herein with a nucleic acid vector encoding the at least one fusion polypeptide provided herein. The vector can be added to the cell culture medium of the cells by methods known in the art and discussed further below.

A vector is a nucleic acid construct designed for delivery to a host cell or for transfer of genetic material between different host cells. As used herein, a vector can be viral or non-viral. The term "vector" encompasses any genetic element that is capable of replication when associated with the proper control elements and that can transfer genetic material to cells. A vector can include, but is not limited to, a cloning vector, an expression vector, a plasmid, phage, transposon, cosmid, artificial chromosome, virus, virion, etc. In some embodiments of any of the aspects, the vector is selected from the group consisting of: a plasmid, a cosmid and a viral vector.

"Expression" refers to the cellular processes involved in producing RNA and proteins and as appropriate, secreting proteins, including where applicable, but not limited to, for example, transcription, transcript processing, translation and protein folding, modification and processing. "Expression products" include RNA transcribed from a gene, and polypeptides obtained by translation of mRNA transcribed from a gene.

In some embodiments, a vector is capable of driving expression of one or more sequences in a mammalian cell; i.e., the vector is a mammalian expression vector. Examples of mammalian expression vectors include pCDM8 (Seed, 1987. Nature 329: 840) and pMT2PC (Kaufman, et al., 1987. EMBO J. 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant expression vector is capable of directing expression of the exogenous fusion polypeptide nucleic acid sequence preferentially in a particular cell type (e.g., via tissue-specific regulatory elements).

Tissue-specific and inducible regulatory elements are known in the art. Non-limiting examples of suitable tissue-specific promoters include the albumin promoter (liver-specific; Pinkert, et al., 1987. Genes Dev. 1: 268-277), lymphoid-specific promoters (Calame and Eaton, 1988. Adv. Immunol. 43: 235-275), in particular promoters of T cell receptors (Winoto and Baltimore, 1989. EMBO J. 8: 729-733) and immunoglobulins (Baneiji, et al., 1983. Cell 33:

729-740; Queen and Baltimore, 1983. *Cell* 33: 741-748), neuron-specific promoters (e.g., the neurofilament promoter; Byrne and Ruddle, 1989. *Proc. Natl. Acad. Sci. USA* 86: 5473-5477), pancreas-specific promoters (Edlund, et al., 1985. *Science* 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. *Science* 249: 374-379) and the α-fetoprotein promoter (Campes and Tilghman, 1989. *Genes Dev.* 3: 537-546).

In some embodiments, the at least one nucleic acid sequence described herein is delivered to the cell described herein via an integrating vector. Integrating vectors have their delivered genetic material (or a copy of it) permanently incorporated into a host cell chromosome. Non-integrating vectors remain episomal which means the nucleic acid contained therein is never integrated into a host cell chromosome. Examples of integrating vectors include retroviral vectors, lentiviral vectors, hybrid adenoviral vectors, and herpes simplex viral vectors.

In some embodiments, the at least one nucleic acid sequence described herein is delivered to the cell described herein via a non-integrative vector. Non-integrative vectors include non-integrative viral vectors. Non-integrative viral vectors eliminate one of the primary risks posed by integrative retroviruses, as they do not incorporate their genome into the host DNA. One example is the Epstein Barr oriP/Nuclear Antigen-1 ("EBNA1") vector, which is capable of limited self-replication and known to function in mammalian cells. Containing two elements from Epstein-Barr virus, oriP and EBNA1, binding of the EBNA1 protein to the virus replicon region oriP maintains a relatively long-term episomal presence of plasmids in mammalian cells. This particular feature of the oriP/EBNA1 vector makes it ideal for generation of integration-free host cells. Other non-integrative viral vectors include adenoviral vectors and the adeno-associated viral (AAV) vectors.

Another non-integrative viral vector is RNA Sendai viral vector, which can produce protein without entering the nucleus of an infected cell. The F-deficient Sendai virus vector remains in the cytoplasm of infected cells for a few passages, but is diluted out quickly and completely lost after several passages (e.g., 10 passages). This permits a self-limiting transient expression of a chosen heterologous gene or genes in a target cell. This aspect can be helpful, e.g., for the transient introduction of reprogramming factors, among other uses. As noted above, in some embodiments, the nucleic acid sequence described herein is expressed in the cells from a viral vector.

A "viral vector" includes a nucleic acid vector construct that includes at least one element of viral origin and has the capacity to be packaged into a viral vector particle. The viral vector can contain a nucleic acid encoding a polypeptide described herein in place of non-essential viral genes. The vector and/or particle can be utilized for the purpose of transferring nucleic acids into cells either in vitro or in vivo.

The nucleic acids described herein can be delivered using any transfection reagent or other physical means that facilitates entry of nucleic acids into a cell. Methods of non-viral delivery of nucleic acids include lipofection, nucleofection, microinjection, electroporation, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

An "agent that increases cellular uptake" is a molecule that facilitates transport of a molecule, e.g., nucleic acid, or peptide or polypeptide, or other molecule that does not otherwise efficiently transit the cell membrane across a lipid membrane. For example, a nucleic acid can be conjugated to a lipophilic compound (e.g., cholesterol, tocopherol, etc.), a cell penetrating peptide (CPP) (e.g., penetratin, TAT, Syn1B, etc.), or a polyamine (e.g., spermine). Further examples of agents that increase cellular uptake are disclosed, for example, in Winkler (2013). *Oligonucleotide conjugates for therapeutic applications. Ther. Deliv.* 4(7); 791-809. The one or more nucleic acid sequences encoding the fusion polypeptides provided herein can be delivered to the cell by any method discussed above or known in the art.

In some embodiments of any of the aspects, the vectors provided herein comprise a nucleic acid modification by methods known in the art. In some embodiments, the cell can be genetically manipulated to express one or more vectors, each encoding one or more vesicle targeting domains and/or one or more signaling domains. In certain embodiments, the population of cells has been genetically manipulated. This includes, for example, knockout (KO) or transgenic (TG) cell lines, wherein an endogenous gene has been removed and/or an exogenous introduced in a stable, persistent manner. In certain embodiments, this further includes transient knockdown of one or more genes and associated coding and non-coding transcripts within the population of cells, via any number of methods known in the art, such as introduction of dsRNA, siRNA, microRNA, etc. This further includes transient expression of one or more genes and associated coding and non-coding transcripts within the population of cells, via any number of methods known in the art, such as introduction of a vector, plasmid, artificial plasmid, replicative and/or non-replicative virus, etc.

In certain embodiments the cell population has been manipulated to knockout the expression of one or more endogenous gene sequences that encode for metalloendopeptidases. In certain embodiments the cell population has been manipulated to knockout the expression of one or more endogenous gene sequences that code for metalloproteinases. In certain embodiments the cell population has been manipulated to knockout the expression of one or more endogenous gene sequences that encode for a disintegrin and metalloproteinase (ADAM). For example, the cell population can be manipulated to knock of the expression of one or more gene sequences that encode for ADAM1, ADAM2, ADAM7, ADAMS, ADAMS, ADAM10, ADAM11, ADAM12, ADAM15, ADAM17, ADAM18, ADAM19, ADAM20, ADAM21, ADAM22, ADAM23, ADAM28, ADAM29, ADAM30, ADAM33, etc.

In certain embodiments the cell population has been manipulated to knockout the expression of one or more endogenous genes that encode for enzymes that hydrolyze the inositol phosphate linkage in proteins anchored by phosphatidylinositol glycans, thereby preventing the release of proteins attached to the plasma membrane via GPI anchors. For example, the cell population can be manipulated to knock of the expression of phosphatidylinositol-glycan-specific phospholipase D (GPLD1).

In certain embodiments, the population of cells has been genetically manipulated. This includes, for example, knock-in of an exogenous genetic sequence, wherein the exogenous genetic sequence is expressed in a stable, persistent manner. In certain embodiments, the cell population has been manipulated to knock-in recombinase recognition sequences (e.g., FRT), transgenic reporters such as antibiotic resistance genes, fluorescent or enzymatic reporter genes, etc. or the like.

In some embodiments, the method comprises a step of isolating the engineered extracellular vesicles provided herein. Particulates within the medium are removed by a series of specific centrifugation steps and the media is filtered. The general method of isolating extracellular vesicles as provided herein is depicted in FIG. 21 of the working examples. Methods of isolating and purifying the extracellular vesicles and exosomes are known in the art and further described, e.g., in Whitford W, Guterstam P. Exosome manufacturing status. Future Med Chem. 2019 May; 11(10):1225-1236. doi: 10.4155/fmc-2018-0417. PMID: 31280675, Patel D B, Santoro M, Born L J, Fisher J P, Jay S M. Towards rationally designed biomanufacturing of therapeutic extracellular vesicles: impact of the bioproduction microenvironment. Biotechnol Adv. 2018 December; 36(8):2051-2059. doi: 10.1016/j.biotechadv.2018.09.001. Epub 2018 Sep. 12. PMID: 30218694; PMCID: PMC6250573, Ng K S, Smith J A, McAteer M P, Mead B E, Ware J, Jackson F O, Carter A, Ferreira L, Bure K, Rowley J A, Reeve B, Brindley D A, Karp J M. Bioprocess decision support tool for scalable manufacture of extracellular vesicles. Biotechnol Bioeng. 2019 February; 116(2): 307-319. doi: 10.1002/bit.26809. Epub 2018 Nov. 8. PMID: 30063243; PMCID: PMC6322973, Paganini C, Capasso Palmiero U, Pocsfalvi G, Touzet N, Bongiovanni A, Arosio P. Scalable Production and Isolation of Extracellular Vesicles: Available Sources and Lessons from Current Industrial Bioprocesses. Biotechnol J. 2019 October; 14(10):e1800528. doi: 10.1002/biot.201800528. Epub 2019 Jul. 8. PMID: 31140717, which are incorporated herein by reference in their entireties.

In some embodiments, isolating the plurality of engineered EVs (artificial synapses) includes precipitation, centrifugation, filtration, immuno-separation, tangential flow, liquid chromatography, and/or flow fractionation. For example, differential ultracentrifugation has become a technique wherein secreted exosomes are isolated from the supernatants of cultured cells. This approach allows for separation of exosomes from non-membranous particles, by exploiting their relatively low buoyant density. Size exclusion allows for their separation from biochemically similar, but biophysically different microvesicles, which possess larger diameters of up to 1,000 nm. Differences in floatation velocity further allows for separation of differentially sized exosomes. In general, exosome sizes will possess a diameter ranging from 30-300 nm, including sizes of 30-150 nm. Further purification may rely on specific properties of the particular exosomes of interest. This includes, for example, use of immunoadsorption with a protein of interest to select specific vesicles with exoplasmic or outward orientations.

Among current methods (differential centrifugation, discontinuous density gradients, immunoaffinity, ultrafiltration and liquid chromatography (e.g., fast protein liquid chromatography (FPLC)), differential ultracentrifugation is the most commonly used for exosome isolation. This technique utilizes increasing centrifugal force from 2000×g to 10,000×g to separate the medium- and larger-sized particles and cell debris from the exosome pellet at 100,000×g. Centrifugation alone allows for significant separation/collection of exosomes from a conditioned medium, although it is insufficient to remove various protein aggregates, genetic materials, particulates from media and cell debris that are common contaminants. Enhanced specificity of exosome purification may deploy sequential centrifugation in combination with ultrafiltration, or equilibrium density gradient centrifugation in a sucrose density gradient, to provide for the greater purity of the exosome preparation (flotation density 1.1-1.2 g/ml) or application of a discrete sugar cushion in preparation.

Ultrafiltration can be used to purify exosomes without compromising their biological activity. Membranes with different pore sizes—such as 100 kDa molecular weight cut-off (MWCO) or 300 kDa MWCO and gel filtration to eliminate smaller particles—have been used to avoid the use of a nonneutral pH or non-physiological salt concentration. Currently available tangential flow filtration (TFF) systems are scalable (to >10,000 L), allowing one to not only purify, but concentrate the exosome fractions, and such approaches are less time consuming than differential centrifugation. Liquid Chromatography can also be used to purify exosomes to homogeneously sized particles and preserve their biological activity as the preparation is maintained at a physiological pH and salt concentration.

Other chemical methods have exploit differential solubility of exosomes for precipitation techniques, addition to volume-excluding polymers (e.g., polyethylene glycols (PEGs)), possibly combined additional rounds of centrifugation or filtration. For example, a precipitation reagent, ExoQuick®, can be added to conditioned cell media to quickly and rapidly precipitate a population of exosomes, although re-suspension of pellets prepared via this technique may be difficult. Flow field-flow fractionation (FlFFF) is an elution-based technique that is used to separate and characterize macromolecules (e.g., proteins) and nano- to micro-sized particles (e.g., organelles and cells) and which has been successfully applied to fractionate exosomes from culture media.

Beyond these techniques relying on general biochemical and biophysical features, focused techniques may be applied to isolated specific exosomes of interest. This includes relying on antibody immunoaffinity to recognizing certain exosome-associated antigens. Conjugation to magnetic beads, chromatography matrices, plates or microfluidic devices allows isolating of specific exosome populations of interest as may be related to their production from a parent cell of interest or associated cellular regulatory state. Other affinity-capture methods use lectins which bind to specific saccharide residues on the exosome surface.

In several embodiments, isolating a plurality of artificial synapses from the population of cells includes centrifugation of the cells and/or media conditioned by the cells. In several embodiments, ultracentrifugation is used. In several embodiments, isolating a plurality of artificial synapses from the population of cells is via size-exclusion filtration. In other embodiments, isolating a plurality of artificial synapses from the population of cells includes use of discontinuous density gradients, immunoaffinity, ultrafiltration, tangential flow and/or liquid chromatography.

In certain embodiments, differential ultracentrifugation includes using centrifugal force from 1000-2000×g, 2000-3000×g, 3000-4000×g, 4000-5000×g, 5000×g-6000×g, 6000-7000×g, 7000-8000×g, 8000-9000×g, 9000-10,000×g, to 10,000×g or more to separate larger-sized particles from a plurality of artificial synapses derived from the cells.

In other embodiments, isolating a plurality of artificial synapses from the population of cells includes use of filtration or ultrafiltration. In certain embodiments, a size exclusion membrane with different pore sizes is used. For example, a size exclusion membrane can include use of a filter with a pore size of 0.1-0.5 micron (μm), 0.5-1.0 μm, 1-2.5 μm, 2.5-5 μm, 5 or more μm. In certain embodiments, the pore size is about 0.2 μm. In certain embodiments, filtration or ultrafiltration includes size exclusion ranging from 100-500 daltons (Da), 500-1 kDa, 1-2 kDa, 2-5 kDa, 5-10 kDa, 10-25 kDa, 25-50 kDa, 50-100 kDa, 100-250 kDa, 250-500 kDa, 500 or more kDa. In certain embodiments, the size exclusion is for about 2-5 kDa. In certain embodiments, the size exclusion is for about 3 kDa. In other embodiments, filtration or ultrafiltration includes size exclusion includes use of hollow fiber membranes capable of isolating particles ranging from 100-500 daltons (Da), 500-1 kDa, 1-2 kDa, 2-5 kDa, 5-10 kDa, 10-25 kDa, 25-50 kDa, 50-100 kDa, 100-250 kDa, 250-500 kDa, 500 or more kDa. In certain embodiments, the size exclusion is for about 2-5 kDa. In certain embodiments, the size exclusion is for about 3 kDa. In other embodiments, a molecular weight cut-off (MWCO) gel filtration capable of isolating particles ranging from 100-500 daltons (Da), 500-1 kDa, 1-2 kDa, 2-5 kDa, 5-10 kDa, 10-25 kDa, 25-50 kDa, 50-100 kDa, 100-250 kDa, 250-500 kDa, 500 or more kDa. In certain embodiments, the size exclusion is for about 2-5 kDa. In certain embodiments, the size exclusion is for about 3 kDa. In various embodiments, such systems are used in combination with variable fluid flow systems. In certain embodiments, a size exclusion membrane with different pore sizes is used to purify extracellular vesicles from a solution comprising undesirable proteins or nucleic acids.

In other embodiments, isolating a plurality of artificial synapses from the population of cells includes use of tangential flow filtration (TFF) systems are used purify and/or concentrate the exosome fractions. In other embodiments, isolating a plurality of artificial synapses from the population of cells includes use of liquid chromatography can also be used to purify artificial synapses to homogeneously sized particles. In various embodiments, density gradients as used, such as centrifugation in a sucrose density gradient or application of a discrete sugar cushion in preparation.

In other embodiments, isolating a plurality of artificial synapses from the population of cells includes use of a precipitation reagent. For example, a precipitation reagent, ExoQuick®, can be added to conditioned cell media to quickly and rapidly precipitate a population of artificial synapses. In other embodiments, isolating a plurality of artificial synapses from the population of cells includes use of volume-excluding polymers (e.g., polyethylene glycols (PEGs)) are used. In another embodiment, isolating a plurality of artificial synapses from the population of cells includes use of flow field-flow fractionation (FlFFF), an elution-based technique.

In certain embodiments, isolating a plurality of artificial synapses from the population of cells includes use of one or more capture agents to isolate one or more artificial synapses possessing specific biomarkers or containing particular biological molecules. In one embodiment, one or more capture agents include at least one antibody. For example, antibody immunoaffinity recognizing exosome-associated antigens is used to capture specific artificial synapses. In other embodiments, the at least one antibody are conjugated to a fixed surface, such as magnetic beads, chromatography matrices, plates or microfluidic devices, thereby allowing isolation of the specific exosome populations of interest. In other embodiments, isolating a plurality of artificial synapses from the population of cells includes use of one or more capture agents that is not an antibody. This includes, for example, use of a "bait" molecule presenting an antigenic feature complementary to a corresponding molecule of interest on the exosome surface, such as a receptor or other coupling molecule. In one embodiment, the non-antibody capture agent is a lectin capable of binding to polysaccharide residues on the exosome surface.

In other embodiments, isolating a plurality of artificial synapses from the population of cells includes use of ion exchange chromatography. In other embodiments, isolating a plurality of artificial synapses from the population of cells includes use of anion exchange chromatography. In other embodiments, isolating a plurality of artificial synapses from the population of cells includes use of cation exchange chromatography. In certain embodiments, ion exchange chromatography comprises a chromatography resin with a functional group selected from the group consisting of diethylaminoethyl (DEAE), quaternary aminoethyl (QAE), quaternary ammonium (Q), carboxymethyl (CM), sulfopropyl (SP), or methyl sulfate (S). In certain embodiments, ion exchange chromatography comprises a chromatography resin which may have properties of a weak acid, strong acid, weak base, or strong basic. In certain embodiments, ion exchange chromatography comprises a chromatography selected from the group consisting of DEAE cellulose, DEAE Sephadex, Mono Q, Mini Q, HiTrap Capto, Capto Core 700, HiPrep Q, QAE Sephadex, Q Sepharose, CM Cellulose, SP Sepharose, SOURCE S, EAH-Sepharose, sulfoxyethyl cellulose, CM Sephadex, or CM Sepharose. Isolating a plurality of artificial synapses can be prepared by any of a variety of ion exchange chromatography techniques that are known in the art.

In other embodiments, isolating a plurality of artificial synapses from the population of cells includes use of a nuclease enzyme (e.g., a DNase or RNase). For example, a working concentration of Benzonase® nuclease may be added to an extracellular vesicle sample preparation in the presence of a divalent cation, for example 1-2 mM $Mg^{2+}$, 2-5 mM $Mg^{2+}$, 10-20 mM $Mg^{2+}$, 20-50 mM $Mg^{2+}$, 50-100 mM $Mg^{2+}$, or more than 100 mM $Mg^{2+}$.

Following isolation and purification of the engineered EVs provided herein, EVs can be further evaluated for the desired structural and functional properties by methods known in the art. For example, the engineered exosomes provided herein can be assayed for functional activity on a target cell using a cell-based bioassays (e.g., those commercially available, Promega DiscoverX®), ligand-receptor binding assays, vesicle flow cytometric assays, enzyme-linked immunosorbent assays, tunable resistive pulse sensing (TRPS), nanoparticle tracking analysis (NTA), surface plasmon resonance (SSPR), nucleotide sequencing, lipidomics, proteomics, colorimetric assays, fluorescence assays, luminescence assays, immunoblotting, radioimmunoassays, electron microscopy, or EV automated analysis (e.g., Exoview®). Additional methods of characterizing EVs are found, e.g., in Zhang Y, Bi J, Huang J, Tang Y, Du S, Li P.

Exosome: A Review of Its Classification, Isolation Techniques, Storage, Diagnostic and Targeted Therapy Applications. Int J Nanomedicine. 2020 Sep. 22; 15:6917-6934. doi: 10.2147/IJN.S264498. PMID: 33061359; PMCID: PMC7519827, Kluszczyńska K, Czernek L, Cypryk W, Pęczek Ł, Düchler M. Methods for the Determination of the Purity of Exosomes. Curr Pharm Des. 2019; 25(42):4464-4485. doi: 10.2174/1381612825666191206162712. PMID: 31808383, Nolan J P, Duggan E. Analysis of Individual Extracellular Vesicles by Flow Cytometry. Methods Mol Biol. 2018; 1678:79-92. doi: 10.1007/978-1-4939-7346-0_5. PMID: 29071676; Doyle L M, Wang M Z. Overview of Extracellular Vesicles, Their Origin, Composition, Purpose, and Methods for Exosome Isolation and Analysis. Cells. 2019 Jul. 15; 8(7):727. doi: 10.3390/cells8070727. PMID: 31311206; PMCID: PMC6678302, Pugholm L H, Revenfeld A L, Søndergaard E K, Jørgensen M M. Antibody-Based Assays for Phenotyping of Extracellular Vesicles. Biomed Res Int. 2015; 2015:524817. doi: 10.1155/2015/524817. Epub 2015 Dec. 3. PMID: 26770974; PMCID: PMC4681819, Shao H, Im H, Castro C M, Breakefield X, Weissleder R, Lee H. New Technologies for Analysis of Extracellular Vesicles. Chem Rev. 2018 Feb. 28; 118(4): 1917-1950. doi: 10.1021/acs.chemrev.7b00534. Epub 2018 Jan. 31. PMID: 29384376; PMCID: PMC6029891, which are incorporated herein by reference in their entireties.

Pharmaceutical Compositions

Provided herein are compositions comprising the engineered extracellular vesicles (artificial synapses) provided herein.

In one aspect, provided herein is a composition comprising: a plurality of the engineered extracellular vesicles provided herein. In some embodiments of any of the aspects, the compositions and engineered EVs provided herein further comprise a pharmaceutically acceptable carrier.

For clinical use of the methods and compositions described herein, administration of the engineered EVs/artificial synapses provided herein can include formulation into pharmaceutical compositions or pharmaceutical formulations for parenteral administration, e.g., intravenous; mucosal, e.g., intranasal; ocular, or other mode of administration. In some embodiments, the engineered EVs described herein can be administered along with any pharmaceutically acceptable carrier compound, material, or composition which results in an effective treatment in the subject. Thus, a pharmaceutical formulation for use in the methods described herein can contain the engineered EVs described herein in combination with one or more pharmaceutically acceptable ingredients. The phrase "pharmaceutically acceptable" refers to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio. The phrase "pharmaceutically acceptable carrier" as used herein means a pharmaceutically acceptable material, composition or vehicle, such as a liquid or solid filler, diluent, excipient, solvent, media, encapsulating material, manufacturing aid (e.g., lubricant, talc magnesium, calcium or zinc stearate, or steric acid), or solvent encapsulating material, involved in maintaining the stability, solubility, or activity of, an engineered EV as described herein. Each carrier must be "acceptable" in the sense of being compatible with the other ingredients of the formulation and not injurious to the patient. The terms "excipient," "carrier," "pharmaceutically acceptable carrier" or the like are used interchangeably herein.

The engineered EVs provided herein can be formulated for administration of the compound to a subject in solid, liquid, or gel form, including those adapted for the following: (1) parenteral administration, for example, by subcutaneous, intramuscular, intravenous or epidural injection as, for example, a sterile solution or suspension, or sustained-release formulation; (2) transdermally; (3) transmucosally; (4) via bronchoalveolar lavage.

In some embodiments, the compositions described herein comprise a particle or polymer-based vehicle. Exemplary particle or polymer-based vehicles include, but are not limited to, nanoparticles, microparticles, polymer microspheres, or polymer-drug conjugates.

In one embodiment of any of the aspects, the compositions described herein further comprise a lipid vehicle. Exemplary lipid vehicles include, but are not limited to, liposomes, phospholipids, micelles, lipid emulsions, and lipid-drug complexes.

Formulations can be adapted for delivery to the airway, e.g., to address respiratory inflammation. Such formulations can be adapted for delivery as an aerosol, e.g., for inhalation. In some embodiments, the compositions described herein are formulated for aerosol administration, nebulizer administration, tracheal lavage administration, or for a pulmonary delivery device.

As used herein, the term "pulmonary delivery device" refers to a device used to deliver a therapeutic dose of a composition of the present invention to the respiratory system including, but not limited to, a nebulizer, metered-dose inhaler, or dry powder inhaler.

Examples of nebulizers include, but are not limited to, soft mist inhalers (for example Respimat® Boehringer Ingelheim) jet nebulizers (use compressed gas or air), ultrasonic nebulizers (produce aerosols using a piezoelectric crystal vibrating at high frequencies), and vibrating mesh nebulizers.

As used herein, the term "jet nebulizer" refers to a device that flows compressed air or gas through a composition of the present invention for aerosolization. The aerosolized composition of the present invention may be inhaled by a patient. Jet nebulizer may include, but is not limited to, jet nebulizers with a corrugated tube, jet nebulizers with a collection bag, breath enhanced jet nebulizers, breath actuated jet nebulizers, and metered-dose inhalers. Examples of jet nebulizers include, but are not limited to, Circulaire (Westmed INC, Tucson, Ariz.), Pari Inhalierboy (PARI, Midlothian, Va.), Pari LC Plus (PARI, Midlothian, Va.), NebuTech (Salter Labs, Arvin, Calif.), AeroEclipse (Monoghan/Trudell Medical International, London, Ontario, Canada), and Maxin MA-2 (MA-2; Clinova Medical AB, Malmö, Sweden). Examples of ultrasonic nebulizers include, but are not limited to, DeVilbiss-Pulmosonic (Somerset, Pa.), Omron-Microair (Omron, Kyoto, Japan), Omron NE-U17 (Omron, Kyoto, Japan), Rhone Poulenc-Rorer-Fisoneb (Sanofi, Paris, France), and Beurer Nebulizer IH30 (Beurer GmbH, Neu-Ulm, Germany).

As used herein, the term "mesh nebulizer" refers to forcing a liquid, gel, fluid, solution, tincture, or the like through apertures in a mesh or aperture plate to generate aerosol. Mesh nebulizer may include, but is not limited to, active mesh nebulizers and passive mesh nebulizers. Examples of active mesh nebulizers include, but is not limited to, Aeroneb® (Aerogen, Galway, Ireland) and eFlow® (PARI, Midlothian, Va.). Examples of passive mesh nebulizers are, but not limited to, I-neb (Philips Respironics, Newark, USA), AKITA (Activaero, Gemunden/Wohra, Germany), and Microair NE-U22® (Omron, Kyoto, Japan).

For use as aerosols, the compositions described herein can be prepared in a solution or suspension and may be packaged in a pressurized aerosol container together with suitable propellants, for example, hydrocarbon propellants like propane, butane, or isobutane with conventional excipients.

The engineered EVs provided herein can also be administered in a non-pressurized form such as in a nebulizer or atomizer that reduces a liquid to a fine spray. Preferably, by such nebulization small liquid droplets of uniform size are produced from a larger body of liquid in a controlled manner. Nebulization can be achieved by any suitable means therefor, including by using many nebulizers known and marketed today. For example, an AEROMIST™ pneumatic nebulizer available from Inhalation Plastic, Inc. of Niles, Ill.

When the active ingredients are adapted to be administered, either together or individually, via nebulizer(s) they can be in the form of a nebulized aqueous suspension or solution, with or without a suitable pH or tonicity adjustment, either as a unit dose or multi-dose device.

Furthermore, any suitable gas can be used to apply pressure during the nebulization, with preferred gases to date being those which are chemically inert. Exemplary gases including, but are not limited to, nitrogen, argon, or helium can be used to advantage.

In some embodiments, the compositions described herein can also be administered directly to the airways in the form of a dry powder. Thus, the engineered EVs can be administered via an inhaler. Exemplary inhalers include metered dose inhalers and dry powdered inhalers.

A metered dose inhaler or "MDT" is a pressure resistant canister or container filled with a product such as a pharmaceutical composition dissolved in a liquefied propellant or micronized particles suspended in a liquefied propellant. The propellants which can be used include chlorofluorocarbons, hydrocarbons or hydrofluoroalkanes. Commonly used propellants are P134a (tetrafluoroethane) and P227 (heptafluoropropane) each of which may be used alone or in combination. They are optionally used in combination with one or more other propellants and/or one or more surfactants and/or one or more other excipients, for example ethanol, a lubricant, an anti-oxidant and/or a stabilizing agent.

As used herein, the term "dry powder inhaler" refers to a device that delivers a therapeutic dose of a composition of the present invention in a powdered form without propellants to the respiratory system. A dry powder inhaler (i.e., Turbuhaler™ (Astra AB)) is a system operable with a source of pressurized air to produce dry powder particles of a pharmaceutical composition that is compacted into a very small volume. Examples of dry powder inhalers include, but are not limited to, Spinhaler® (Fisons Pharmaceuticals, Rochester, N.Y.), Rotahaler® (GlaxoSmithKline, NC), Turbuhaler® (AstraZeneca, UK), and Diskhaler® (GlaxoSmithKline, NC).

Dry powder aerosols for inhalation therapy are generally produced with mean diameters primarily in the range of <5 mm. As the diameter of particles exceeds 3 mm, there is increasingly less phagocytosis by macrophages. However, increasing the particle size also has been found to minimize the probability of particles (possessing standard mass density) entering the airways and acini due to excessive deposition in the oropharyngeal or nasal regions.

Suitable powder compositions include, by way of illustration, powdered preparations including the engineered EVs described herein. These can be intermixed with lactose, or other inert powders acceptable for intrabronchial administration. The powder compositions can be administered via an aerosol dispenser or encased in a breakable capsule which may be inserted by the patient or clinician into a device that punctures the capsule and blows the powder out in a steady stream suitable for inhalation. The compositions can include propellants, surfactants, and co-solvents and may be filled into conventional aerosol containers that are closed by a suitable metering valve.

Aerosols for the delivery to the respiratory tract are described, for example, by Adjei, A. and Garren, J. Pharm. Res., 1: 565-569 (1990); Zanen, P. and Lamm, J.-W. J. Int. J. Pharm., 114: 111-115 (1995); Gonda, I. "Aerosols for delivery of therapeutic and diagnostic agents to the respiratory tract," in Critical Reviews in Therapeutic Drug Carrier Systems, 6:273-313 (1990); Anderson et al., Am. Rev. Respir. Dis., 140: 1317-1324 (1989)) and have potential for the systemic delivery of peptides and proteins as well (Patton and Platz, Advanced Drug Delivery Reviews, 8:179-196 (1992)); Timsina et. al., Int. J. Pharm., 101: 1-13 (1995); and Tansey, I. P., Spray Technol. Market, 4:26-29 (1994); French, D. L., Edwards, D. A. and Niven, R. W., Aerosol Sci., 27: 769-783 (1996); Visser, J., Powder Technology 58: 1-10 (1989)); Rudt, S. and R. H. Muller, J. Controlled Release, 22: 263-272 (1992); Tabata, Y, and Y. Ikada, Biomed. Mater. Res., 22: 837-858 (1988); Wall, D. A., Drug Delivery, 2: 10 1-20 1995); Patton, J. and Platz, R., Adv. Drug Del. Rev., 8: 179-196 (1992); Bryon, P., Adv. Drug. Del. Rev., 5: 107-132 (1990); Patton, J. S., et al., Controlled Release, 28: 15 79-85 (1994); Damms, B. and Bains, W., Nature Biotechnology (1996); Niven, R. W., et al., Pharm. Res., 12(9); 1343-1349 (1995); and Kobayashi, S., et al., Pharm. Res., 13(1): 80-83 (1996), the contents of each of which are incorporated herein by reference in their entirety.

Microemulsification technology can improve bioavailability of some lipophilic (water insoluble) pharmaceutical agents. Examples include Trimetrine (Dordunoo, S. K., et al., Drug Development and Industrial Pharmacy, 17(12), 1685-1713, 1991 and REV 5901 (Sheen, P. C., et al., J Pharm Sci 80(7), 712-714, 1991). Among other things, microemulsification provides enhanced bioavailability by preferentially directing absorption to the lymphatic system instead of the circulatory system, which thereby bypasses the liver, and prevents destruction of the cell-based compositions in the hepatobiliary circulation.

The engineered EVs described herein can be formulated with an amphiphilic carrier. Amphiphilic carriers are saturated and monounsaturated polyethyleneglycolyzed fatty acid glycerides, such as those obtained from fully or partially hydrogenated various vegetable oils. Such oils may advantageously consist of tri-, di-, and mono-fatty acid glycerides and di- and mono-polyethyleneglycol esters of the corresponding fatty acids, with a particularly preferred fatty acid composition including capric acid 4-10, capric acid 3-9, lauric acid 40-50, myristic acid 14-24, palmitic acid 4-14 and stearic acid 5-15%. Another useful class of amphiphilic carriers includes partially esterified sorbitan and/or sorbitol, with saturated or mono-unsaturated fatty acids (SPAN-series) or corresponding ethoxylated analogs (TWEEN-series).

Commercially available amphiphilic carriers are particularly contemplated, including Gelucire-series, Labrafil, Labrasol, or Lauroglycol (all manufactured and distributed by Gattefosse Corporation, Saint Priest, France), PEG-mono-oleate, PEG-di-oleate, PEG-mono-laurate and di-laurate, Lecithin, Polysorbate 80, etc. (produced and distributed by a number of companies in USA and worldwide).

The engineered EV compositions provided herein can be formulated with hydrophilic polymers. Hydrophilic polymers are water-soluble, can be covalently attached to a vesicle-forming lipid, and which are tolerated in vivo without toxic effects (i.e., are biocompatible). Suitable polymers include polyethylene glycol (PEG), polylactic (also termed polylactide), polyglycolic acid (also termed polyglycolide), a polylactic-polyglycolic acid copolymer, and polyvinyl alcohol. Other hydrophilic polymers which may be suitable include polyvinylpyrrolidone, polymethoxazoline, polyethyloxazoline, polyhydroxypropyl methacrylamide, polymethacrylamide, polydimethylacrylamide, and derivatized celluloses such as hydroxymethylcellulose or hydroxyethylcellulose.

In certain embodiments, a pharmaceutical composition as described herein comprises a biocompatible polymer selected from the group consisting of polyamides, polycarbonates, polyalkylenes, polymers of acrylic and methacrylic esters, polyvinyl polymers, polyglycolides, polysiloxanes, polyurethanes and co-polymers thereof, celluloses, polypropylene, polyethylenes, polystyrene, polymers of lactic acid and glycolic acid, polyanhydrides, poly(ortho)esters, poly (butic acid), poly(valeric acid), poly(lactide-co-caprolactone), polysaccharides, proteins, polyhyaluronic acids, polycyanoacrylates, and blends, mixtures, or copolymers thereof.

In certain embodiments, a pharmaceutical composition described herein is formulated as a liposome. Liposomes can be prepared by any of a variety of techniques that are known in the art. See, e.g., U.S. Pat. No. 4,235,871; Published PCT applications WO 96/14057; New RRC, Liposomes: A practical approach, IRL Press, Oxford (1990), pages 33-104; Lasic D D, Liposomes from physics to applications, Elsevier Science Publishers BV, Amsterdam, 1993.

Therapeutic formulations of the engineered EV compositions as described herein can be prepared for storage by with optional pharmaceutically acceptable carriers, excipients or stabilizers (*Remington's Pharmaceutical Sciences* 16th edition, Osol, A. Ed. (1980)), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

Vaccine or other pharmaceutical compositions comprising an engineered EV composition as described herein can contain a pharmaceutically acceptable salt, typically, e.g., sodium chloride, and preferably at about physiological concentrations. The formulations of the vaccine or other pharmaceutical compositions described herein can contain a pharmaceutically acceptable preservative. In some embodiments, the preservative concentration ranges from 0.1 to 2.0%, typically v/v. Suitable preservatives include those known in the pharmaceutical arts. Benzyl alcohol, phenol, m-cresol, methylparaben, and propylparaben are examples of preservatives. The formulations of the vaccine or other pharmaceutical compositions described herein can include a pharmaceutically acceptable surfactant at a concentration of 0.005 to 0.02%.

Therapeutic pharmaceutical compositions described herein can also contain more than one active compound as necessary for the particular indication being treated, preferably those with complementary activities that do not adversely affect each other.

In some embodiments in which the engineered EVs are formulated for use in or with a vaccine, the vaccine composition can be formulated with the engineered EVs as an adjuvant. In other embodiments the vaccine composition can be formulated with the engineered EVs and an additional adjuvant, e.g., as known in the art.

As used herein in the context of immunization, immune response and vaccination, the term "adjuvant" refers to any substance than when used in combination with a specific antigen produces a more robust immune response than the antigen alone. When incorporated into a vaccine formulation, an adjuvant acts generally to accelerate, prolong, or enhance the quality of specific immune responses to the vaccine antigen(s). Adjuvants typically promote the accumulation and/or activation of accessory cells or factors to enhance antigen-specific immune responses and thereby enhance the efficacy of vaccines, i.e., antigen-containing or encoding compositions used to induce protective immunity against the antigen.

Adjuvants, in general, include adjuvants that create a depot effect, immune-stimulating adjuvants, and adjuvants that create a depot effect and stimulate the immune system. An adjuvant that creates a depot effect is an adjuvant that causes the antigen to be slowly released in the body, thus prolonging the exposure of immune cells to the antigen. This class of adjuvants includes but is not limited to alum (e.g., aluminum hydroxide, aluminum phosphate); emulsion-based formulations including mineral oil, non-mineral oil, water-in-oil or oil-in-water-in oil emulsion, oil-in-water emulsions such as Seppic ISA series of Montanide adjuvants (e.g., Montanide ISA 720; AirLiquide, Paris, France); MF-59 (a squalene-in-water emulsion stabilized with Span 85 and Tween 80; Chiron Corporation, Emeryville, Calif.); and PROVAX™ (an oil-in-water emulsion containing a stabilizing detergent and a micelle-forming agent; IDEC Pharmaceuticals Corporation, San Diego, Calif.).

An immune-stimulating adjuvant is an adjuvant that causes activation of a cell of the immune system. It may, for instance, cause an immune cell to produce and secrete cytokines and interferons. This class of adjuvants includes but is not limited to saponins purified from the bark of the *Q. saponaria* tree, such as QS21 (a glycolipid that elutes in the 21st peak with HPLC fractionation; Aquila Biopharmaceuticals, Inc., Worcester, Mass.); poly [di(carboxylatophenoxy)phosphazene (PCPP polymer; Virus Research Institute, USA); derivatives of lipopolysaccharides such as monophosphoryl lipid A (MPL; Ribi ImmunoChem Research, Inc., Hamilton, Mont.), muramyl dipeptide (MDP; Ribi) and threonyl-muramyl dipeptide (t-MDP; Ribi); OM-174 (a glucosamine disaccharide related to lipid A; OM Pharma SA, Meyrin, Switzerland); and *Leishmania* elongation factor (a purified *Leishmania* protein; Corixa Corporation, Seattle, Wash.). This class of adjuvants also includes CpG DNA.

Adjuvants that create a depot effect and stimulate the immune system are those compounds which have both of the above-identified functions. This class of adjuvants includes but is not limited to ISCOMS (immunostimulating complexes which contain mixed saponins, lipids and form virus-sized particles with pores that can hold antigen; CSL, Melbourne, Australia); SB-AS2 (SmithKline Beecham adjuvant system #2 which is an oil-in-water emulsion containing MPL and QS21: SmithKline Beecham Biologicals [SBB], Rixensart, Belgium); SB-AS4 (SmithKline Beecham adjuvant system #4 which contains alum and MPL; SBB, Belgium); non-ionic block copolymers that form micelles such as CRL 1005 (these contain a linear chain of hydrophobic polyoxypropylene flanked by chains of polyoxyethylene; Vaxcel, Inc., Norcross, Ga.); and Syntex Adjuvant Formulation (SAF, an oil-in-water emulsion containing Tween 80 and a nonionic block copolymer; Syntex Chemicals, Inc., Boulder, Colo.).

The active ingredients of the pharmaceutical compositions described herein can also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in *Remington's Pharmaceutical Sciences* 16th edition, Osol, A. Ed. (1980).

In some embodiments, sustained-release preparations can be used. Suitable examples of sustained-release preparations include semipermeable matrices of solid hydrophobic polymers containing a composition described herein in which the matrices are in the form of shaped articles, e.g., films, or microcapsule. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and y ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(-)-3-hydroxybutyric acid. While polymers such as ethylene-vinyl acetate and lactic acid-glycolic acid enable release of molecules for over 100 days, certain hydrogels release proteins for shorter time periods. When encapsulated, the composition can remain in the body for a long time (e.g., up to about 1 hour, between 1-12 hours, 12-24 hours, 24 hours to 2 days, 2-3 days, 3-4 days, 4-5 days, 5-6 days, 6-7 days, 1-2 weeks, 3-4 weeks, 4 weeks to 2 months, 2-3 months, 3-4 months, 4-5 months, 5-6 months, or more than 6 months, or a variation thereof), denature, or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S— bond formation through thio-disulfide interchange, stabilization can be achieved by modifying sulfhydryl residues, lyophilizing from acidic solutions, controlling moisture content, using appropriate additives, and developing specific polymer matrix compositions.

Administration, Dosing, Efficacy

The engineered EV compositions, pharmaceutical compositions, or vaccine compositions described herein can be formulated, dosed, and administered in a fashion consistent with good medical practice. Factors for consideration in this context include the particular disorder being treated, the particular subject being treated, the clinical condition of the individual subject, the cause of the disorder, the site of delivery of the vaccine composition, the method of administration, the scheduling of administration, and other factors known to medical practitioners.

Generally, application of artificial synapses as therapy will take into account similar parameters as other therapeutic strategies, including concentration, timing of delivery, and sustained bioavailability at injury/disease site. Extracellular vesicle can be delivered via a number of routes: intravenous, intracoronary, and intramyocardial. Extracellular vesicles (e.g., exosomes), also allow for new delivery routes that were previously infeasible for cell therapy, such as inhalation or injection. These various approaches are described below, including injection, topical application, enteral administration, and pulmonary delivery.

The engineered EV compositions provided herein can be administered to a subject in need thereof by any appropriate route which results in an effective treatment in the subject. As used herein, the terms "administering," and "introducing" are used interchangeably and refer to the placement of a composition provided herein into a subject by a method or route which results in at least partial localization of such compositions at a desired site, such as a site of inflammation or a tumor, such that a desired effect(s) is produced. The compositions can be administered to a subject by any mode of administration that delivers the composition systemically or to a desired surface or target, and can include, but is not limited to, injection, infusion, instillation, and inhalation administration. To the extent that the composition can be protected from inactivation in the gut, oral administration forms are also contemplated. "Injection" includes, without limitation, intravenous, intramuscular, intra-arterial, intrathecal, intraventricular, intracapsular, intraorbital, retro-orbital, intravitreal, intraocular, intracardiac, intradermal, intraperitoneal, transtracheal, subcutaneous, subcuticular, intraarticular, sub capsular, subarachnoid, intraspinal, intracerebral, intratarsal, and intrasternal, intratumoral injection, and infusion or the like as known in the art.

A therapeutic does of the present invention may be delivered to a patient by means of controlled release, for example but not limited to, implantable pump and implantable cannulas to provide continuous access to the venous or arterial system.

Topical application refers to applying or spreading a composition of the present invention onto surfaces on or in the body, both internally and/or externally, in a therapeutically effective amount for local and/or systemic treatment. Topical application may be epicutaneous wherein a composition of the present invention may be directly applied onto a localized surface of the skin or mucous membranes. Topical application may include transdermal application wherein a composition of the present invention may be absorbed into the body to obtain systemic delivery and systemic distribution. Topical application formulations may include, but are not limited to, creams, foams, gels, lotions, solutions, ointments, dermal patch, transdermal patches, powder, solid, sponge, tape, vapor, paste, film, liposomes, balm, shampoo, spray, or tincture or the like or a combination thereof. A therapeutic dose of a composition of the present invention may be delivered vaginally (for example a vaginal suppository, vaginal ring, douche, intrauterine device, intravesical infusion, and the like) or urethra or the like or a combination thereof.

Enteral administration refers to a composition of the present invention administered via the gastrointestinal tract in a therapeutically effective amount for local or systemic treatment. Enteral administration may include, but is not limited to, delivery of a composition of the present invention via the mouth, sublingual, esophagus, gastric (for example the stomach), small intestines, large intestines or rectum. Oral delivery of the present invention may include, but is not limited to, the use of a capsule, pastille, pill, tablet, solution, gel, suspension, emulsion, syrup, elixir, tincture, mouthwash, lozenges, chewing gum, lollipop, cream, foam, solution, powder, solid, vapor, liposomes, spray, or tincture osmotic-controlled release oral delivery system, or the like. Gastric delivery may involve the use of a tube or nasal passage that leads directly to the stomach, for example, a percutaneous endoscopic gastrostomy tube. Gastric delivery may involve direct injection made through the abdominal wall. Rectal delivery may involve, but is not limited to, the use of a suppository, ointment, enema, murphy drip, or the like. A therapeutic does of the present invention may be delivered to a patient by means of controlled release, for example but not limited to, controlled release drug delivery pellet or pill.

Inhalation (i.e., pulmonary delivery, pulmonary administration refers to delivery to the respiratory system through the respiratory route, including but not limited to, intranasal administration, oral administration, and oral inhalative administration (e.g. intratracheal instillation and intratracheal inhalation) of a therapeutically effective amount for local or systemic treatment. Pulmonary delivery of a therapeutically effective amount of a composition of the present invention may be achieved by dispersion, for example by using a syringe. Pulmonary delivery of a composition of the present invention may be achieved by aerosol administration, wherein aerosol administration may deposit a therapeutically effective amount of the present invention by gravitational sedimentation, inertial impaction, or diffusion.

Intravenous delivery technique can occur through a peripheral or central venous catheter. As the simplest delivery mode, this technique avoids the risk of an invasive procedure. However, intravenous may be regarded as a comparatively inefficient and less localized delivery method, as a high percentage of infused cell exosomes may become sequestered in organs such as the lung, liver, or spleen. Such sequestration may result in few or no cellular exosomes reaching broader circulation or have unintended systemic effects following their distribution.

In certain embodiments, administration can include delivery to a tissue or organ site that is the same as the site of diseased and/or dysfunctional tissue. In certain embodiments, administration can include delivery to a tissue or organ site that is different from the site or diseased and/or dysfunctional tissue. In certain embodiments, the delivery is via inhalation or oral administration. In various embodiments, administration of artificial synapses can include combinations of multiple delivery techniques.

In some embodiments, the compositions described herein are administered by aerosol administration, nebulizer administration, or tracheal lavage administration.

The term "effective amount" as used herein refers to the amount of an engineered EV composition needed to alleviate or prevent at least one or more symptom of a disease or disorder (e.g., autoimmune disease or cancer), and relates to a sufficient amount of pharmacological composition to provide the desired effect, e.g., reduce the pathology, or any symptom associated with or caused by the a disease. The term "therapeutically effective amount" therefore refers to an amount of an engineered EV composition or vaccine composition described herein using the methods as disclosed herein, that is sufficient to affect a particular disease state when administered to a typical subject. An effective amount as used herein would also include an amount sufficient to delay the development of a symptom of the disease, alter the course of a symptom disease (for example, but not limited to, slow the progression of a symptom of the disease), or reverse a symptom of the disease. Thus, it is not possible to specify the exact "effective amount." However, for any given case, an appropriate "effective amount" can be determined by one of ordinary skill in the art using only routine experimentation.

Effective amounts, toxicity, and therapeutic efficacy can be determined by standard pharmaceutical procedures in cell cultures or experimental animals, e.g., for determining the LD50 (the dose lethal to 50% of the population) and the ED50 (the dose therapeutically effective in 50% of the population). The dosage can vary depending upon the dosage form employed and the route of administration utilized. The dose ratio between toxic and therapeutic effects is the therapeutic index and can be expressed as the ratio LD50/ED50. Compositions and methods that exhibit large therapeutic indices are preferred. A therapeutically effective dose can be estimated initially from cell culture assays. Also, a dose can be formulated in animal models to achieve a circulating plasma concentration range that includes the IC50 (i.e., the concentration of the engineered EVs or fusion polypeptides provided herein), which achieves a half-maximal inhibition of symptoms) as determined in cell culture, or in an appropriate animal model. Levels of therapeutic engineered EVs in plasma can be measured, for example, by high performance liquid chromatography, enzyme linked immunosorbent assay (ELISA), flow cytometry, FACS sorting, western blot, mass spectroscopy, tunable resistive pulse sensing, ExoView®, qRT-PCR, next generation sequencing (NGS), or by any analysis technique known by one of ordinary skill in the art. The effects of any particular dosage can be monitored by a suitable bioassay. The dosage can be determined by a physician and adjusted, as necessary, to suit observed effects of the treatment.

The engineered EV compositions, pharmaceutical compositions, or vaccine compositions described herein can be formulated, in some embodiments, with one or more additional therapeutic agents currently used to prevent or treat the infection, for example. The effective amount of such other agents depends on the amount of an engineered EV in the formulation, the type of disorder or treatment, and other factors discussed above. These are generally used in the same dosages and with administration routes as used herein before or about from 1 to 99% of the heretofore employed dosages.

The dosage ranges for the pharmaceutical compositions described herein depend upon the potency and encompass amounts large enough to produce the desired effect. The dosage should not be so large as to cause unacceptable adverse side effects. Generally, the dosage will vary with the age, condition, health, and sex of the patient and can be determined by one of skill in the art. The dosage can also be adjusted by the individual physician in the event of any complication. In some embodiments, the dosage ranges from 0.001 mg/kg body weight to 100 mg/kg body weight. In some embodiments, the dose range is from 5 µg/kg body weight to 100 µg/kg body weight. Alternatively, the dose range can be titrated to maintain serum levels between 0.1 µg/mL and 1000 µg/mL. For systemic administration, subjects can be administered a therapeutic amount, such as, e.g., 0.1 mg/kg, 0.5 mg/kg, 1.0 mg/kg, 2.0 mg/kg, 2.5 mg/kg, 5 mg/kg, 7.5 mg/kg, 10 mg/kg, 15 mg/kg, 20 mg/kg, 25 mg/kg, 30 mg/kg, 40 mg/kg, 50 mg/kg, or more. These doses can be administered by one or more separate administrations, or by continuous infusion. For repeated administrations over several days or longer, depending on the condition, the treatment is sustained until, for example, the infection is treated, as measured by the methods described above or known in the art. However, other dosage regimens can be useful.

In various embodiments, the quantities of artificial synapses that are administered to achieve these effects range from $1\times10^6$ to $1\times10^7$, $1\times10^7$ to $1\times10^8$, $1\times10^8$ to $1\times10^9$, $1\times10^9$ to $1\times10^{10}$, $1\times10^{10}$ to $1\times10^{11}$, $1\times10^{11}$ to $1\times10^{12}$, $1\times10^{12}$ to $1\times10^{13}$, $1\times10^{13}$ to $1\times10^{14}$, $1\times10^{14}$ to $1\times10^{15}$, $1\times10^{15}$ or more EVs/artificial synapses. In other embodiments, the numbers of artificial synapses are relative to the number of cells used in a clinically relevant dose for a cell-therapy method. For example, defining an effective dose range, dosing regimen and route of administration, may be guided by studies using fluorescently labeled artificial synapses, and measuring target tissue retention, which can be >10×, >50×, or >100× background, as measured 5, 10, 15, 30, or 30 or more min as a screening criterion. In certain embodiments, >100× background measured at 30 mins is a baseline measurement for a low and high dose that is then assess for safety and bioactivity (e.g., using MRI endpoints: scar size, global and regional function of the target organ being treated). In various embodiments, single doses are compared to two, three, four, four or more sequentially-applied doses. In various embodiments, the repeated or sequentially-applied doses are provided for treatment of an acute disease and/or condition. In various embodiments, the repeated or sequentially-applied doses are provided for treatment of a chronic disease and/or condition. In other embodiments, administration of the plurality of artificial synapses is adjunctive to standard therapy.

In other embodiments, administering a composition includes $1\times10^{10}$ or more artificial synapses in a single dose. In various embodiments, exosome quantity may be defined by protein quantity, such as dosages including 1-10, 10-25, 25-50, 50-75, 75-100, or 100 or more mg exosome protein. In other embodiments, a single dose is administered multiple times to the subject. In other embodiments, administering a composition consists of one or more of: injection, topical administration, enteral, intravenous, intra-arterial, or inhalation.

In various embodiments, exosome quantity may be defined by protein quantity, such as dosages including 1-10, 10-25, 25-50, 50-75, 75-100, or 100 or more mg exosome protein. In various embodiments, administering a composition includes multiple dosages of the artificial synapses. In various embodiments, the repeated or sequentially-applied doses are provided for treatment of an acute disease and/or condition. In various embodiments, the repeated or sequentially-applied doses are provided for treatment of a chronic disease and/or condition.

In other embodiments, administering a composition including a plurality of artificial synapses to the subject is adjunctive to standard therapy.

The duration of a therapy using the methods described herein will continue for as long as medically indicated or until a desired therapeutic effect (e.g., those described herein) is achieved. In certain embodiments, the administration of the vaccine composition described herein is continued for 1 month, 2 months, 4 months, 6 months, 8 months, 10 months, 1 year, 2 years, 3 years, 4 years, 5 years, 10 years, 20 years, or for a period of years up to the lifetime of the subject.

As will be appreciated by one of skill in the art, appropriate dosing regimens for a given composition can comprise a single administration/immunization or multiple ones. Subsequent doses may be given repeatedly at time periods, for example, about two weeks or greater up through the entirety of a subject's life, e.g., to provide a sustained preventative effect. Subsequent doses can be spaced, for example, about two weeks, about three weeks, about four weeks, about one month, about two months, about three months, about four months, about five months, about six months, about seven months, about eight months, about nine months, about ten months, about eleven months, or about one year after a primary immunization.

The precise dose to be employed in the formulation will also depend on the route of administration and should be decided according to the judgment of the practitioner and each patient's circumstances. Ultimately, the practitioner or physician will decide the amount of the engineered EV or composition thereof to administer to particular subjects.

Methods of Modulating Inflammation and Treating Autoimmune Diseases

The artificial synapses/engineered EVs and compositions thereof provided herein can be deployed in a therapeutic strategy against virtually any injury/disease, as providing a platform for altering biological signaling. This includes, for example, inflammation and immune signaling, which plays a role in virtually all injuries and diseases in living organisms.

Thus, described herein is a method of modulating inflammation, including selecting a subject afflicted with an inflammatory related disease and/or condition; and administering to the subject a composition including a plurality of artificial synapses (engineered EVs) to the subject, wherein administration of the composition modulates inflammation.

As used herein, the term "inflammation" or "inflamed" refers to activation or recruitment of the immune system or immune cells (e.g. T cells, B cells, macrophages). A tissue that has inflammation can become reddened, white, swollen, hot, painful, sensitivity, exhibit a loss of function, or have a film or mucus. Methods of identifying inflammation are well known in the art. Inflammation typically occurs following injury, infection by a microorganism, exposure to a substance (e.g., a toxin, chemical, or dust) or autoimmune dysfunction. Onset of inflammation may be rapid (e.g., immediately following injury) or slow (e.g., repeated exposure to an irritant such as a chemical over time) with a duration of minutes, hours, days, months, years, or an individual's life.

Inflammation plays a vital role in alerting the immune system of potential danger and damage within a body. Inflammation is necessary to control and repair injury. For example, acute inflammation is a response to physical trauma, infection, and stress. Acute inflammation helps prevent further injury and triggers healing and recovery. Unfortunately, inflammation can become excessive and inappropriately active, lasting beyond the typical recovery time from an injury or infection. Wherein healthy inflammation helps a body respond to injury, chronic inflammation perpetuates injury and may lead to negative consequences to one's health. In particular, autoimmune diseases are chronic diseases from a host's immune system attacking itself, often due to aberrant biological signaling in the host. Restoring normal homeostatic signaling via application of artificial synapses, particularly targeting immune checkpoints, represents a highly promising avenue. For example, surface bound immune-checkpoint proteins or fragments thereof may modulate immune cell stimulation and affect suppression of immune cell function when delivered via artificial synapses. Injection, inhalation, ingestion or topical application of artificial synapses with surface bound immune-checkpoint proteins or fragments thereof may be used to treat immune, auto-immune, inflammatory, and auto-inflammatory conditions. Examples include chronic obstructive pulmonary disease (COPD) which is an inflammatory, progressive, life-threatening lung disease, psoriasis, a common chronic noncommunicable inflammatory skin disease, arthritis, a debilitating and painful degeneration of joints, among others well-understood to one of skill in the art.

In other embodiments, the inflammatory related disease and/or condition is acute, for example septicemia. In other embodiments, the inflammatory related disease and/or condition is chronic, for example chronic obstructive pulmonary disease. In other embodiments, the inflammatory condition is an autoimmune disease wherein the autoimmune disease and/or condition is one or more of: polymyositis, dermatomyositis, Graves' disease, Hashimoto's thyroiditis, myasthenia gravis, vasculitis, multiple sclerosis, psoriasis, rheumatoid arthritis, psoriatic arthritis, scleroderma, systemic lupus erythematosus, inflammatory bowel disease, Crohn's disease, hyperthyroidism, autoimmune adrenal insufficiency, Sjogren syndrome, type I diabetes mellitus, autoimmune hemolytic anemia, idiopathic thrombocytopenic purpura, myasthenia gravis, ulcerative colitis, uveitis, polyarteritis nodosa, relapsing polychondritis, Behcet's disease, reactive arthritis, ankylosing spondylitis, Guillain-Barre syndrome, or optic neuropathy. In other embodiments, the disease and/or condition is chronic obstructive pulmonary disease, rheumatoid arthritis, uveoretinitis, psoriasis, and eczema. In other embodiments, the disease and/or condition is irritable bowel disease, multiple sclerosis or lupus In other embodiments, the inflammatory related disease and/or condition is an ocular disease. As used herein, the terms "ocular disease", "eye disorder" and "eye disease" are used interchangeably and refer to a disease or disorder that affects the health and/or vision of either one or both eyes or the general area of the eye(s), eye lid(s), or area surrounding or in near proximity to the eye(s). Eye disease may include, but are not limited to, macular degeneration (e.g., age-related macular degeneration), cataracts, diabetic retinopathy, diabetic macular edema, eye floaters, eye flashes, glaucoma, amblyopia, strabismus, retinitis (e.g., CMV retinitis), color blindness, keratoconus, retinal detachment, eyelid twitching, ocular hypertension, blepharitis, uveitis, Bietti's crystalline dystrophy, blepharospasm, cornea and corneal diseases, dry eye, histoplasmosis, macular hole, macular pucker, conjunctivitis, presbyopia, retinoblastoma, retinitis pigmentosa, retinopathy, Stargardt disease, Usher syndrome, uveal Coloma, and vitreous detachment, or the like.

Described herein is a method for treatment including, selecting a subject in need of treatment, administering a composition including a plurality of artificial synapses to the individual, wherein administration of the composition treats the subject. In certain embodiments, the subject is in need to treatment for a disease and/or condition involving tissue damage or dysfunction.

Described herein is a method of treating an autoimmune disease, inflammation, inflammatory disease or condition, or cancer in a subject, the method comprising: administering to a subject the an engineered EV or composition thereof as provided herein to the subject.

Measured or measurable parameters include clinically detectable markers of disease, for example, elevated or depressed levels of a clinical or biological marker, as well as parameters related to a clinically accepted scale of symptoms or markers for a disease or disorder. It will be understood, however, that the total usage of the compositions and formulations as disclosed herein will be decided by the attending physician within the scope of sound medical judgment. The exact amount required will vary depending on factors such as the type of disease being treated.

Non-limiting examples of clinical tests that can be used to assess autoimmune diseases, inflammatory conditions, or inflammation parameters include blood tests, skin biopsy, MRI, eye examination, ocular pressure tests, etc. Where necessary or desired, animal models of injury or disease can be used to gauge the effectiveness of a particular composition as described herein. For example, an EAU animal model, as demonstrated in the working examples can be used.

In various embodiments, administration of the plurality of artificial synapses alters gene expression in the damaged or dysfunctional tissue, improves viability of the damaged tissue, and/or enhances regeneration or production of new tissue in the individual. In various embodiments, administration of the plurality of artificial synapses alters gene expression in the damaged or dysfunctional tissue, improves viability of the damaged tissue, and/or enhances regeneration or production of new tissue in the individual.

In various embodiments, the damaged or dysfunctional tissue is in need of repair, regeneration, or improved function due to an acute event. Acute events include, but are not limited to, trauma such as laceration, crush or impact injury, shock, loss of blood or oxygen flow, infection, chemical or heat exposure, poison or venom exposure, drug overuse or overexposure, and the like. Other sources of damage also include, but are not limited to, injury, age-related degeneration, cancer, and infection. In several embodiments, the regenerative cells used to prepare the engineered EVs provided herein are from the same tissue type as is in need of repair or regeneration. In several other embodiments, the regenerative cells are from a tissue type other than the tissue in need of repair or regeneration. In some embodiments, the engineered EVs provided herein are derived from the subject being treated. In some embodiments, the engineered EVs are derived from a donor subject.

In other embodiments, the damaged or dysfunctional tissue is in need of repair, regeneration, or improved function due to damage from chronic disease.

Some Selected Definitions

All references cited herein are incorporated by reference in their entirety as though fully set forth. Unless defined otherwise, technical and scientific terms used herein have the same meaning as commonly understood by one of ordinary skill in the art to which this invention belongs. Allen et al., *Remington: The Science and Practice of Pharmacy* $22^{nd}$ ed., Pharmaceutical Press (Sep. 15, 2012); Hornyak et al., *Introduction to Nanoscience and Nanotechnology*, CRC Press (2008); Singleton and Sainsbury, *Dictionary of Microbiology and Molecular Biology* $3^{rd}$ ed., revised ed., J. Wiley & Sons (New York, N.Y. 2006); Smith, *March's Advanced Organic Chemistry Reactions, Mechanisms and Structure* $7^{th}$ ed., J. Wiley & Sons (New York, N.Y. 2013); Singleton, *Dictionary of DNA and Genome Technology* $3^{rd}$ ed., Wiley-Blackwell (Nov. 28, 2012); and Green and Sambrook, *Molecular Cloning: A Laboratory Manual* 4th ed., Cold Spring Harbor Laboratory Press (Cold Spring Harbor, N.Y. 2012), provide one skilled in the art with a general guide to many of the terms used in the present application. For references on the preparation and structure of antibodies and fusion polypeptides, see, e.g., Greenfield, *Antibodies A Laboratory Manual* 2<sup>nd</sup> ed, Cold Spring Harbor Press (Cold Spring Harbor N.Y., 2013); Köhler and Milstein, Derivation of specific antibody-producing tissue culture and tumor lines by cell fusion, *Eur. J. Immunol.* 1976 July, 6(7):511-9; Queen and Selick, Humanized immunoglobulins, U.S. Pat. No. 5,585,089 (1996 December); and Riechmann et al., Reshaping human antibodies for therapy, *Nature* 1988 Mar. 24, 332(6162):323-7. See also, Kabat et al., *Sequences of Proteins of Immunological Interest*, 5th Ed. Public Health Service, National Institutes of Health, Bethesda, Md. (1991), Lanzavecchia et al., *Eur. J. Immunol.* 17, 105 (1987)), Huston et al., *Proc. Natl. Acad. Sci. U.S.A.,* 85, 5879-5883 (1988), Bird et al., *Science* 242, 423-426 (1988), Brinkman et al. mAbs Vol 9, No. 2, 182-212 (2017), *Chothia & Lesk, J. Mol. Biol,* 196:901-917 (1987), Chothia et al., *Nature* 342:877-883 (1989)), Holliger et al. (1993) *Proc. Natl. Acad. Sci. USA* 90: 6444-6448; Poljak (1994) *Structure* 2: 1121-1123); Kontermann and Dubel eds., Antibody Engineering, Springer-Verlag, N.Y. (2001), p. 790 (ISBN 3-540-41354-5, Zapata et al. (1995) *Protein Eng.* 8(10): 1057-1062; Morrison, et al., *Proc. Natl. Acad. Sci. USA,* 81:6851 (1984), U.S. Pat. Nos. 4,816,567, 5,693,780, which are incorporated herein by reference in their entireties.

One skilled in the art will recognize many methods and materials similar or equivalent to those described herein, which could be used in the practice of the present invention. Indeed, the present invention is in no way limited to the methods and materials described. For purposes of the present invention, the following terms are defined below.

As used herein, the term "extracellular vesicle" and "vesicle" are used interchangeably and refer to a particle, wherein the particle comprises a phospholipid bilayer that encloses an internal space and an exterior surface and may or may not be derived from a cell. The size of extracellular vesicles can range between 20 nm to 3 µm in diameter but may be smaller than 20 nm or larger than 3 µm. Examples of extracellular vesicles include, but is not limited to, exosomes (for example small exosomes and large exosomes), ectosomes, macrovesicles, microparticles, apoptotic bodies, vesicular organelles, oncosomes (for examples large oncosomes), exospheres, exomeres, cell derived nanovesicles (CDN) (e.g., by genesis via grating or shearing cells), liposomes or the like known by one of ordinary skill in the art. Extracellular vesicles may originate naturally via known or unknown biosynthetic pathways. Extracellular vesicles may be promoted to originate by using mechanical methods such as cell grating or cell shearing wherein a cell is grated or sheared causing portions or parts of the cell membrane to from vesicles. For example, CDNs may be formed by using mechanical methods such as cell grating or cell shearing wherein a cell is grated or sheared causing portions or parts of the cell membrane to from vesicles. Additional non-limiting examples of mechanical methods that can be used to form cell derived nanovesicles are further described in detail, e.g., Gob, W. J., Zou, S., Ong, W Y. et al. Bioinspired Cell-Derived Nanovesicles versus Exosomes as Drug Delivery Systems: a Cost-Effective Alternative. *Sci Rep* 7, 14322 (2017). https://doi.org/10.1038/s41598-017-14725-x, the contents of which are incorporated herein by reference in their entireties.

Extracellular vesicles comprise cargo, wherein the term "cargo" refers to peptides, proteins, nucleic acids, lipids, metabolites, carbohydrates, biomolecules, small molecules, large molecules, vesicles, organelles, or fragments thereof. In some embodiments, cargo may refer to existing drugs or therapeutics known in the art. Extracellular vesicle cargo may be located within the internal space of the extracellular vesicle. Extracellular vesicle cargo may be membrane bound and span one or both layers of the extracellular vesicle phospholipid bilayer (for example a transmembrane protein). Extracellular vesicle cargo may be in contact with the external or internal surface of the extracellular vesicle, for example through a covalent bond or a non-covalent bond. The phospholipid bilayer of the extracellular vesicle may comprise one or more transmembrane proteins, wherein a portion of the one or more transmembrane membrane proteins is located within the internal space of the extracellular vesicle. The phospholipid bilayer of the extracellular vesicle may comprise one or more transmembrane proteins, wherein the one or more transmembrane membrane proteins comprises a domain on the exterior of the extracellular vesicle. The phospholipid bilayer of the extracellular vesicle may comprise one or more transmembrane proteins, wherein the one or more transmembrane membrane proteins comprises a domain on the interior of the extracellular vesicle. Cargo may refer to a protein on the luminal side (e.g., in the internal space) of the extracellular vesicle wherein said protein encodes a vesicle targeting domain that may be in contact with the interior phospholipid layer of the extracellular vesicle. Cargo may refer to a protein on the luminal side (e.g., in the internal space) of the extracellular vesicle wherein said protein encodes a vesicle targeting domain that may be in contact with the interior phospholipid layer of the extracellular vesicle and wherein said protein may be presented into the internal space of the extracellular vesicle.

As used herein, the terms "sticky binder" and "vesicle targeting domain" and "anchor protein" are used interchangeably and refer to a protein that is covalently or non-covalently attached to at least one lipid wherein the one or more lipid is embedded within a membrane (e.g. a cell membrane), and the lipid serves to anchor the protein to the membrane. The terms "sticky binder" and "vesicle targeting domain" and "anchor protein" can also mean a protein sequence that encodes for one or more transmembrane domains wherein the one or more transmembrane domains spans at least partly through a phospholipid bilayer, for example the phospholipid bilayer of an extracellular vesicle. The transmembrane domain can be of a Type I or Type II membrane protein. Transmembrane domains can be structurally identified using methods known to those of skill in the art, such as sequence analysis programs that identify hydrophobic and hydrophilic domains (for example TMHMM Server, v. 2.0—DTU, Erik L. L. Sonnhammer, Gunnar von Heijne, and Anders Krogh: *A hidden Markov model for predicting transmembrane helices in protein sequences*. In Proc. of Sixth Int. Conf. on Intelligent Systems for Molecular Biology, p 175-182 Ed J. Glasgow, T. Littlejohn, F. Major, R. Lathrop, D. Sankoff, and C. Sensen Menlo Park, Calif.: AAAI Press, 1998, which is incorporated herein by reference in its entirety.)

A vesicle targeting domain may include, but is not limited to, one or more prenylation site, fatty acylation site, and/or glycosylphosphatidylinositol (GPI) linked protein. One preferred embodiment of a vesicle targeting domain is the GPI sequence from CD55. Another preferred embodiment of a vesicle targeting domain is the GPI sequence from CD59. Another embodiment of a vesicle targeting domain is the C1C2 domain from MFGE8. Other embodiments of sequences for vesicle targeting domains include transmembrane regions of CD9 (for example transmembrane 2 or 3 of CD9, CD9tm2 or CD9tm3, respectively), K-Ras (for example K-Ras4A and K-Ras4B), transmembrane domain from A Disintegrin and Metalloproteinase Domain-containing protein 10 (ADAM10, also known as CDw156 or CD156c) or other ADAM proteins. Vesicle targeting domains may include one or more sequences from 4F2 (for example 4F2 encoded by the solute carrier family 3 member 2 (SLC3A2) gene which makes up the heavy subunit of CD98). Vesicle targeting domains can include a sequence for one or more myristoylation sites. For example, the protein sequence for a myristoylation site from myristoylated alanine-rich C-kinase substrate (MARCKS) protein. Vesicle targeting domains can include a sequence for one or more palmitoylation sites. For example, the myristoylation sequence from the MARCKS protein may be modified to encode for a palmitoylation site. All variants, isoforms, or fragments or the like known by one of ordinary skill in the art are encompassed by the present invention.

Vesicle targeting domains may include transmembrane sequences from *Homo sapiens* transferrin receptor 2 (TFR2), transcript variant 1 (transferrin receptor protein 2 isoform 1) or versions therefore. In a preferred embodiment, the vesicle targeting domain may be a transmembrane domain from CD298.

As used herein, the terms "proteins" and "peptides" and "polypeptides" are used interchangeably herein to designate a series of amino acid residues connected to the other by peptide bonds between the alpha-amino and carboxy groups of adjacent residues. Although "protein" is often used in reference to relatively large polypeptides, and "peptide" is often used in reference to small polypeptides, usage of these terms in the art overlaps and varies. The term "peptide" as used herein refers to peptides, polypeptides, proteins and fragments of proteins, unless otherwise noted. The terms "protein" and "peptide" are used interchangeably herein when referring to a gene product and fragments thereof. Thus, exemplary peptides or proteins include gene products, naturally occurring proteins, homologs, orthologs, paralogs, fragments and other equivalents, variants, fragments, and analogs of the foregoing.

"As used herein, the term "linker" refers to a synthetic protein sequence of amino acids that is used to connect two polypeptide domains via peptide bonds.

As used herein, the term "fusion protein" refers to a single chimeric protein comprising a protein of interest (e.g. checkpoint protein) joined to an exogenous protein or protein fragment (e.g. an anchor protein), wherein the components of the fusion protein are linked to each other by peptide-bonds, either directly or through a peptide linker. The anchor protein of the fusion protein may enhance incorporation of the fusion protein onto and/or into the membrane of a vesicle, for example the internal and/or external leaflet of the phospholipid bilayer of an exosome membrane. The fusion protein may have at least a part of an amino acid sequence of an immune checkpoint protein or proteins involved in immune synapses. The fusion protein may have at least a part of an amino acid sequence of A2AR, VTCN1, Galectin 9, FGL-1, PECAM-1, TSG-6, STAB-1, NRP1, NRP2, SEMA3A, SEMA3F, RGMB, TIM-3, TIGIT, HLA class I, HLA class II, VISTA, HMGB1, phosphatidylserine, T-cell receptor (TCR), SHP-1, SHP-2, FBXO38, SH2D1A, B7RP1, IDO, NOX2, TNFRSF18, B7-H4, B7-H5, SISP1, B7-H6, B7-H7, APLNR, IFN γ, PD-1, WNT5A, IL-6, IL-10, NKG2 family of C-type lectin receptors, ligands of NKG2 family, killer cell immunoglobulin-like receptors, CD2, CD4, CD8, CD27, CD27 ligand (CD70), CD28, CD28H, CD39, CD40, CD44, CD47, CD63, CD66a, CD80, B7-2, CD86, CD73, CD94, CD96, CD101, CD112, CD112R, CD122, CD134, CD137 (4-1BB), CD137 ligand (4-1BBL), CD152, CD154, CD155, CD158, CD158a, CD158g, CD158h, KIR2DL1, KIR2DS1, KIRDS3, KIR2DS5, CD160, CD172a, CD200, CD200R, CD223, CD226, CD252, CD270, CD272, CD273, CD274, CD275, CD276, CD278, CD279 (PD-1), CD279 ligand (PD-L1/PDL-2), CD328, CD329, and/or CD337. The fusion protein may have a polypeptide linker sequence (e.g., an Fc domain and/or a GSSG linker), followed by an amino acid sequence coding for an anchor protein sequence (e.g., a prenylation site, fatty acylation site, or a GPI sequence) or any isoform, fragment, variation thereof, or a ligand to the aforementioned proteins thereof, or the like known by one of ordinary skill in the art. All variants are encompassed by the present invention.

As used herein, the term "immune synapse" and "cell synapse" are used interchangeably and refer to cell-to-cell interaction wherein said interaction results in activation, suppression, and/or adhesion of either one or more cells. Immune synapse or cell synapse are mediated by proteins that may be cytoplasmic, membrane bound, membrane associated, and/or secreted. Immune or cell synapses may be mediated by one or more "immune checkpoint proteins" which herein refers to any protein that is involved in maintaining immune homeostasis or plays a role in regulating immune activation or suppression. Immune checkpoint proteins may be cytoplasmic, membrane bound, membrane associated, and/or secreted.

As used herein, the term "fragment" or "active fragment" refers to a portion of a nucleic acid or polypeptide provided herein that retains the ability to be expressed by the engineered EVs provided herein. In some embodiments, the active fragment retains the ability to activate a target polypeptide, thereby increasing the activity of said target polypeptide (e.g., suppressing an immune response).

As used herein, the terms "specifically bind" and/or "specifically recognize" or "substantially binds" refers to the affinity of a binding molecule for a target molecule compared to the binding molecule's affinity for non-target molecules. A binding molecule (e.g., a POI domain) that specifically binds a target molecule (e.g., a target polypeptide provided herein) does not substantially recognize or bind non-target molecules. e.g., an antibody "specifically binds" and/or "specifically recognize" another molecule, meaning that this interaction is dependent on the presence of the binding specificity of the molecule structure, e.g., an antigenic epitope. As used herein, "non-specific binding" and "background binding" refers to the interaction that does not depend on the presence of specific structure (e.g., a specific antigenic epitopes). Methods of measuring binding of a polypeptide to a target are known in the art (e.g., differential scanning calorimetry, isothermal titration calorimetry, spectroscopy, crystallography, surface plasmon resonance, co-immunoprecipitation, pulldown assays, crosslinking, yeast two-hybrid system, tandem affinity purification-mass spectroscopy, protein microarrays, bio-layer interferometry, far-Western blots, computational prediction, analytical ultracentrifugation, light scattering, fluorescence spectroscopy, resonance energy transfer, ELISA or ELISPOT assays, or any other assays known in the art).

As used herein, the terms "treat," "treatment," "treating," or "amelioration" refer to therapeutic treatments, wherein the object is to reverse, alleviate, ameliorate, inhibit, slow down or stop the progression or severity of a condition associated with, a disease or disorder. The term "treating" includes reducing or alleviating at least one adverse effect or symptom of a condition, disease or disorder associated with an infection or a cancer. Treatment is generally "effective" if one or more symptoms or clinical markers are reduced. Alternatively, treatment is "effective" if the progression of a disease is reduced or halted. That is, "treatment" includes not just the improvement of symptoms or markers, but also a cessation or at least slowing of progress or worsening of symptoms that would be expected in absence of treatment. Beneficial or desired clinical results include, but are not limited to, alleviation of one or more symptom(s), diminishment of extent of disease, stabilized (i.e., not worsening) state of disease, delay or slowing of disease progression, amelioration or palliation of the disease state, and remission (whether partial or total), whether detectable or undetectable. The term "treatment" of a disease also includes providing relief from the symptoms or side-effects of the disease (including palliative treatment).

As used herein "preventing" or "prevention" refers to any methodology where the disease state does not occur due to the actions of the methodology (such as, for example, administration of a composition or construct as described herein). In one aspect, it is understood that prevention can also mean that the disease is not established to the extent that occurs in untreated controls. Accordingly, prevention of a disease encompasses a reduction in the likelihood that a subject can develop the disease, relative to an untreated subject (e.g., a subject who is not treated with the methods or compositions described herein).

As used herein, the terms "autoimmune condition" and "autoimmune disease" are used interchangeably and refer to any disease characterized by abnormal functioning of the immune system and may include, but is not limited to, achalasia, Addison's disease, adult Still's disease, agammaglobulinemia, alopecia areata, amyloidosis, ankylosing spondylitis, anti-GBM/Anti-TBM nephritis, antiphospholipid syndrome, autoimmune angioedema, autoimmune dysautonomia, autoimmune encephalomyelitis, autoimmune hepatitis, autoimmune inner ear disease (AIED), autoimmune myocarditis, autoimmune oophoritis, autoimmune orchitis, autoimmune pancreatitis, autoimmune retinopathy, autoimmune urticaria, axonal & neuronal neuropathy (AMAN), Baló disease, Behcet's disease, benign mucosal pemphigoid, bullous pemphigoid, Castleman disease, celiac disease, Chagas disease, chronic inflammatory demyelinating polyneuropathy (CIDP), chronic recurrent multifocal osteomyelitis (CRMO), Churg-Strauss syndrome (CSS), eosinophilic granulomatosis (EGPA), cicatricial pemphigoid, Cogan's syndrome, cold agglutinin disease, congenital heart block, coxsackie myocarditis, CREST syndrome, Crohn's disease, dermatitis herpetiformis, dermatomyositis, Devic's disease (neuromyelitis optica), discoid lupus, Dressler's syndrome, endometriosis, eosinophilic esophagitis (EoE), eosinophilic fasciitis, erythema nodosum, essential mixed cryoglobulinemia, Evans syndrome, fibromyalgia, fibrosing alveolitis, giant cell arteritis (temporal arteritis), giant cell myocarditis, glomerulonephritis, Goodpasture's syndrome, granulomatosis with polyangiitis, Graves' disease, Guillain-Barre syndrome, Hashimoto's thyroiditis, hemolytic anemia, Henoch-Schonlein purpura (HSP), Herpes gestationis or pemphigoid gestationis (PG), hidradenitis suppurativa (HS) (acne inversa), hypogammalglobulinemia, IgA nephropathy, IgG4-related sclerosing disease, immune thrombocytopenic purpura (ITP), inclusion body myositis (IBM), interstitial cystitis (IC), juvenile arthritis, type 1 diabetes, juvenile myositis (JM), Kawasaki disease, Lambert-Eaton syndrome, leukocytoclastic vasculitis, lichen planus, lichen sclerosus, ligneous conjunctivitis, linear IgA disease (LAD), lupus, lyme disease chronic, Meniere's disease, microscopic polyangiitis (MPA), mixed connective tissue disease (MCTD), Mooren's ulcer, Mucha-Habermann disease, multifocal motor neuropathy (MMN) or MMNCB, multiple sclerosis, myasthenia gravis, myositis, narcolepsy, neonatal Lupus, neuromyelitis optica, neutropenia, ocular cicatricial pemphigoid, optic neuritis, palindromic rheumatism (PR), PANDA, paraneoplastic cerebellar degeneration (PCD), paroxysmal nocturnal hemoglobinuria (PNH), Parry Romberg syndrome, pars planitis (peripheral uveitis), Parsonage-Turner syndrome, pemphigus, peripheral neuropathy, perivenous encephalomyelitis, pernicious anemia (PA), POEMS syndrome, polyarteritis nodosa, polyglandular syndromes type I, II, III, polymyalgia rheumatica, polymyositis, postmyocardial infarction syndrome, postpericardiotomy syndrome, primary biliary cirrhosis, primary sclerosing cholangitis, progesterone dermatitis, psoriasis, psoriatic arthritis, pure red cell aplasia (PRCA), pyoderma gangrenosum, Raynaud's phenomenon, reactive arthritis, reflex sympathetic dystrophy, relapsing polychondritis, restless legs syndrome (RLS), retroperitoneal fibrosis, rheumatic fever, rheumatoid arthritis, sarcoidosis, Schmidt syndrome, scleritis, scleroderma, Sjögren's syndrome, sperm & testicular autoimmunity, stiff person syndrome (SPS), subacute bacterial endocarditis (SBE), Susac's syndrome, sympathetic ophthalmia (SO), takayasu's arteritis, temporal arteritis/Giant cell arteritis, thrombocytopenic purpura (TTP), Tolosa-Hunt syndrome (THS), transverse myelitis, type 1 diabetes, ulcerative colitis (UC), undifferentiated connective tissue disease (UCTD), uveitis, vasculitis, vitiligo, Vogt-Koyanagi-Harada disease. An autoimmune condition or autoimmune diseases may be caused by, but not limited to, a natural predisposition, a infection (e.g., bacteria or virus), drugs, vaccination, environmental triggers (e.g., toxins or chemicals such as dust, silica, oil, benzene, tri- or per-chloroethylene etc.), stress, cancer, blood or tissue or organ transplantation, or unknown etiology. Autoimmune disorders may result in but not limited to the destruction of body tissue, abnormal growth of an organ or tissue, changes in organ or tissue function (e.g., changes in blood vessels, connective tissue, function of endocrine glands, joints, muscles, blood cells, skin, etc.).

As used herein, the term "cancer" refers to a hyperproliferation of cells that exhibit a loss of normal cellular control that results in unregulated growth, lack of differentiation, local tissue invasion, and metastasis. The methods and compositions described herein can be used for the treatment of solid tumors (e.g., cancer) or non-solid tumors, such as leukemia, blood cell cancers, and the like. Solid tumors can be found in bones, muscles, the brain, or organs, and can be sarcomas or carcinomas. Where the methods and compositions described herein can overcome barriers of tumor treatment, including, but not limited to barriers to treatment or inhibition of metastases, it is contemplated that aspects of the technology described herein can be used to treat all types of solid and non-solid tumor cancers, including cancers not listed in the instant specification. The compositions and methods described herein, without limitation, include methods of treating cancer, methods of inhibiting metastases, and methods of inducing an anti-tumor immune response.

As used herein, the terms "subject", "individual", "host", and "patient" are used interchangeably and may refer to any animal, mammal, bird, fish, reptile, and amphibian, for example, human, monkey, dog, cat, horse, pig, cattle, ox, donkey, rabbit, sheep, goat, mouse, rat, guinea pig, llama, chicken, goose, duck, turkey, or the like receiving or registered to receive a therapeutic amount of a composition of the present invention for medical care or treatment.

As used herein, the term "injection" refers to any process or method which allows the person skilled in the art to administer any therapeutic to a target site by penetration. Examples of injection are, but not limited to, subcutaneous, subcuticular, subcapsular, subarachnoid, intradermal, intramuscular, intravenous, intra-arterial, intraventricular, intracapsular, intraorbital, intraocular, intrathoracic, intraperitoneal, intravitreal, retro-orbital, intranasal, intracerebral, intrathymic, intraspinal, intrasternal, intra-articular, intracavernous, intracardiac, intraosseous, intrathecal, transtracheal, epidural, or the like as known in the art. A therapeutic does of the present invention may be delivered to a patient by means of controlled release, for example but not limited to, implantable pump and implantable cannulas to provide continuous access to the venous or arterial system.

As used herein, the term "topical application" refers to applying or spreading a composition of the present invention onto surfaces on or in the body, both internally and/or externally, in a therapeutically effective amount for local and/or systemic treatment. Topical application may be epicutaneous wherein a composition of the present invention may be directly applied onto a localized surface of the skin or mucous membranes. Topical application may include transdermal application wherein a composition of the present invention may be absorbed into the body to obtain systemic delivery and systemic distribution. For example, a transdermal patch may be applied onto the body to deliver a therapeutic dose of a composition of the invention presented herein. Topical application formulations may include, but are not limited to, creams, foams, gels, lotions, solutions, ointments, dermal patch, transdermal patches, powder, solid, sponge, tape, vapor, paste, film, liposomes, balm, shampoo, spray, or tincture. A therapeutic dose of a composition of the present invention may be delivered vaginally (for example a vaginal suppository, vaginal ring, douche, intrauterine device, intravesical infusion, and the like) or urethra.

As used herein, the term "enteral administration" refers to a composition of the present invention administered via the gastrointestinal tract in a therapeutically effective amount for local or systemic treatment. Enteral administration may include, but is not limited to, delivery of a composition of the present invention via the mouth, sublingual, esophagus, gastric (for example the stomach), small intestines, large intestines or rectum. Oral delivery of the present invention may include, but is not limited to, the use of a capsule, pastille, pill, tablet, solution, gel, suspension, emulsion, syrup, elixir, tincture, mouthwash, lozenges, chewing gum, lollipop, osmotic-controlled release oral delivery system, or the like. Gastric delivery may involve the use of a tube or nasal passage that leads directly to the stomach, for example, a percutaneous endoscopic gastrostomy tube. Gastric delivery may involve direct injection made through the abdominal wall. Rectal delivery may involve, but is not limited to, the use of a suppository, ointment, enema, murphy drip, or the like. A therapeutic does of the present invention may be delivered to a patient by means of controlled release, for example but not limited to, controlled release drug delivery pellet or pill.

As used herein, the terms "pulmonary system" or "respiratory system" are used interchangeably and refer, but are not limited, to the respiratory region, conducting airways, nasal cavity, sinuses, nasopharynx, oropharynx, larynx, trachea, bronchi, bronchioles, respiratory bronchioles, alveolar ducts, alveolar sacs, respiratory epithelium (e.g., alveolar epithelial cells), endothelial cells, or the like.

As used herein, the terms "pulmonary delivery" and "pulmonary administration" are used interchangeably and refer to delivering a composition of the present invention to the respiratory system through the respiratory route, including but not limited to, intranasal administration, oral administration, and oral inhalative administration (e.g., intratracheal instillation and intratracheal inhalation) of a therapeutically effective amount for local or systemic treatment. Pulmonary delivery of a therapeutically effective amount of a composition of the present invention may be achieved by dispersion, for example by using a syringe. Pulmonary delivery of a composition of the present invention may be achieved by aerosol administration, wherein aerosol administration may deposit a therapeutically effective amount of the present invention by gravitational sedimentation, inertial impaction, or diffusion.

Pulmonary delivery of a therapeutically effective amount of a composition of the present invention may be deposited on any mucus layer of the respiratory system, for example, but not limited to, the mucus layer which coats the walls of conducting airways, the smaller airway, and/or alveolar space.

As used herein, an "appropriate control" refers to an untreated, otherwise identical cell or population (e.g., a subject who was not administered the composition described herein, or was administered by only a subset of agents provided herein, as compared to a non-control cell).

As used herein, a "reference level" can refer to one or more parameters or markers as measured for a normal, otherwise unaffected cell population or tissue (e.g., a biological sample obtained from a healthy subject, or a biological sample obtained from the subject at a prior time point, or a biological sample that has not yet been contacted with a pathogen as described herein). For measuring or monitoring therapeutic efficacy, a level determined prior to treatment or earlier in treatment can also provide a reference level for a given parameter or value.

As used herein, the term "modulates" refers to an effect including increasing or decreasing a given parameter as those terms are defined herein.

The terms "increased," "increase," "increases," or "enhance" or "activate" are all used herein to generally mean an increase of a property, level, or other parameter by a statistically significant amount; for the avoidance of any doubt, the terms "increased", "increase" or "enhance" or "activate" means an increase of at least 10% as compared to a reference level, for example an increase of at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, or at least about a 2-fold, or at least about a 3-fold, or at least about a 4-fold, or at least about a 5-fold or at least about a 10-fold increase, at least about a 20-fold increase, at least about a 50-fold increase, at least about a 100-fold increase, at least about a 1000-fold increase or more as compared to a reference level. For example, increasing activity can refer to activating a receptor or a signaling pathway (e.g., antibody production or inflammation).

The terms "decrease", "reduced", "reduction", or "inhibit" are all used herein to mean a decrease or lessening of a property, level, or other parameter by a statistically significant amount. In some embodiments of any of the aspects, "reduce," "reduction" or "decrease" or "inhibit" typically means a decrease by at least 10% as compared to a reference level (e.g., the absence of a given treatment) and can include, for example, a decrease by at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 98%, at least about 99%, or more. As used herein, "reduction" or "inhibition" does not encompass a complete inhibition or reduction as compared to a reference level. "Complete inhibition" is a 100% inhibition as compared to a reference level. A decrease can be preferably down to a level accepted as within the range of normal for an individual without a given disorder.

As used herein the term "comprising" or "comprises" is used in reference to compositions, methods, and respective component(s) thereof, that are essential to the method or composition, yet open to the inclusion of unspecified elements, whether essential or not.

As used herein the term "consisting essentially of" refers to those elements required for a given embodiment. The term permits the presence of elements that do not materially affect the basic and novel or functional characteristic(s) of that embodiment.

The term "consisting of" refers to compositions, methods, and respective components thereof as described herein, which are exclusive of any element not recited in that description of the embodiment.

As used in this specification and the appended claims, the singular forms "a," "an," and "the" include plural references unless the context clearly dictates otherwise. Thus for example, references to "the method" includes one or more methods, and/or steps of the type described herein and/or which will become apparent to those persons skilled in the art upon reading this disclosure and so forth. Similarly, the word "or" is intended to include "and" unless the context clearly indicates otherwise. Although methods and materials similar or equivalent to those described herein can be used in the practice or testing of this disclosure, suitable methods and materials are described below. The abbreviation, "e.g." is derived from the Latin exempli gratia, and is used herein to indicate a non-limiting example. Thus, the abbreviation "e.g." is synonymous with the term "for example."

The abbreviation, "etc." is derived from the Latin et cetera, and is used herein to indicate a non-limiting list. Thus, the abbreviation "etc." is synonymous with the term "and other similar things", or "and so forth".

Other than in the operating examples, or where otherwise indicated, all numbers expressing quantities of ingredients or reaction conditions used herein should be understood as modified in all instances by the term "about." The term "about" when used in connection with percentages can mean±1%.

The term "statistically significant" or "significantly" refers to statistical significance and generally means a two-standard deviation (2SD) difference, above or below a reference value. Additional definitions are provided in the text of individual sections below.

It should be understood that this invention is not limited to the particular methodology, protocols, and reagents, etc., described herein and as such may vary. The terminology used herein is for the purpose of describing particular embodiments only, and is not intended to limit the scope of the present invention, which is defined solely by the claims.

As used herein and in the claims, the singular forms include the plural reference and vice versa unless the context clearly indicates otherwise. The term "or" is inclusive unless modified, for example, by "either." Other than in the oper-ating examples, or where otherwise indicated, all numbers expressing quantities of ingredients or reaction conditions used herein should be understood as modified in all instances by the term "about."

Unless otherwise explained, all technical and scientific terms used herein have the same meaning as commonly understood by one of ordinary skill in the art to which this disclosure belongs.

It is to be understood that the foregoing description and the following examples are illustrative only and are not to be taken as limitations upon the scope of the invention. Various changes and modifications to the disclosed embodiments, which will be apparent to those of skill in the art, may be made without departing from the spirit and scope of the present invention. Further, all patents, patent applications, and publications identified are expressly incorporated herein by reference for the purpose of describing and disclosing, for example, the methodologies described in such publications that might be used in connection with the present invention. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents are based on the information available to the applicants and do not constitute any admission as to the correctness of the dates or contents of these documents.

All patents and other publications identified are expressly incorporated herein by reference for the purpose of describing and disclosing, for example, the methodologies described in such publications that could be used in connection with the present invention. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

Some embodiments of the technology described herein can be defined according to any of the following numbered paragraphs:

1. An engineered extracellular vesicle comprising:
    at least one fusion polypeptide comprising:
        (i) at least one protein of interest (POI) domain or a fragment thereof; and
        (ii) at least one vesicle targeting domain,
    wherein the POI domain is in an extracellular position relative to a lipid membrane of the extracellular vesicle.
2. The engineered extracellular vesicle of paragraph 1, wherein the extracellular vesicle is an exosome.
3. The engineered extracellular vesicle of paragraph 1 or paragraph 2, wherein the protein of interest (POI) domain or a fragment thereof is a N-terminal domain of the fusion polypeptide.
4. The engineered extracellular vesicle of any one of paragraphs 1-3, wherein the vesicle targeting domain is a C-terminal domain of the fusion polypeptide.
5. The engineered extracellular vesicle of any one of paragraphs 1-4, wherein the fusion polypeptide comprises at least two POI domains and/or at least two exosome targeting domains.

6. The engineered extracellular vesicle of any one of paragraphs 1-5, wherein the fusion polypeptide further comprises a peptide linker.
7. The engineered extracellular vesicle of any one of paragraphs 1-6, wherein the fusion polypeptide further comprises a fragment crystallizable region (Fc) domain.
8. The engineered extracellular vesicle of any one of paragraphs 1-7, wherein the vesicle targeting domain is in a luminal position relative to the lipid membrane of the extracellular vesicle.
9. The engineered extracellular vesicle of any one of paragraphs 1-7, wherein the vesicle targeting domain in an exterior position relative to the lipid membrane of the extracellular vesicle.
10. The engineered extracellular vesicle of any one of paragraphs 1-9, wherein the POI domain is selected from the group consisting of: Table 1.
11. The engineered extracellular vesicle of any one of paragraphs 1-10, wherein the POI domain is PD-L1 or a fragment thereof.
12. The engineered extracellular vesicle of any one of paragraphs 1-11, wherein the POI domain is PD-L2 or a fragment thereof.
13. The engineered extracellular vesicle of any one of paragraphs 1-12, wherein the POI domain is FGL1 or a fragment thereof.
14. The engineered extracellular vesicle of any one of paragraphs 1-13, wherein the POI domain is 4-1BBL or a fragment thereof.
15. The engineered extracellular vesicle of any one of paragraphs 1-14, wherein the POI domain is CTLA-4 or a fragment thereof.
16. The engineered extracellular vesicle of any one of paragraphs 1-15, wherein the POI domain substantially binds to one or more of a target polypeptide.
17. The engineered extracellular vesicle of paragraph 16, wherein the target polypeptide is selected from the group consisting of: Table 2.
18. The engineered extracellular vesicle of any one of paragraphs 1-17, wherein the vesicle targeting domain is selected from the group consisting of: Table 3.
19. The engineered extracellular vesicle of any one of paragraphs 1-18, wherein the linker is in an exterior position relative to the lipid membrane of the extracellular vesicle.
20. The engineered extracellular vesicle of any one of paragraphs 1-18, wherein the linker is a transmembrane linker.
21. The engineered extracellular vesicle of any one of paragraphs 1-18, wherein the linker is in a luminal position relative to the lipid membrane of the extracellular vesicle.
22. The engineered extracellular vesicle of any one of paragraphs 1-21, wherein the extracellular vesicle does not comprise an endogenous POI polypeptide.
23. A composition comprising a plurality of the engineered extracellular vesicles of any one of paragraphs 1-22.
24. The composition of paragraph 23, further comprising a pharmaceutically acceptable carrier.
25. An engineered extracellular vesicle comprising:
    (a) a first fusion polypeptide comprising:
        (i) at least one protein of interest (POI) domain or a fragment thereof; and
        (ii) at least one vesicle targeting domain, wherein the at least one POI domain is in an extracellular position relative to a lipid membrane of the extracellular vesicle,
    (b) a second fusion polypeptide comprising:
        (i) at least one protein of interest (POI) domain or a fragment thereof; and
        (ii) at least one vesicle targeting domain,
    wherein the POI domain is in an extracellular position relative to a lipid membrane of the extracellular vesicle,
    and wherein the at least one vesicle targeting domain is within a lipid membrane of the extracellular vesicle.
26. A composition comprising two or more of the engineered extracellular vesicles selected from any one of paragraphs 1-25.
27. An extracellular vesicle composition comprising:
    a plurality of artificial synapses,
    wherein each artificial synapse comprises (i) an extracellular vesicle; (ii) one or more sticky binders; and (iii) one or more signaling domains.
    The composition of paragraph 27, wherein the extracellular vesicle comprises an exosome.
28. The composition of paragraph 27, wherein the one or more sticky binders is selected from the group consisting of: a GPI anchor, a fatty acylation site, and a prenylation site.
30. The composition of paragraph 27, wherein the signaling domain comprises one or more of: PD-L1, PD-L2, CTLA-4 (CD152), 4-1BBL (CD137L), HVEM (CD270), FGL1, OX-2 (CD200), Galectin-9, PVR (CD155), Nectin-2 (CD112) isoform alpha, Nectin-2 (CD112) isoform beta, Nectin-2 (CD112) isoform delta, IL-10, TSG-6, B7-H3 (CD276), B7-H4 (VTCN1), B7-H5 (VISTA), B7-H7 (HHLA2), BTNL1, VSIG8, VSIG3 (IGSF11), VSIG4, TIM-3 (HAVCR2), TIM-4 (TIMD4), CEACAM1, BTN3A1, BTN3A2, BTN2A1, BTNL8, BTN2A2, BTN1A1, TIGIT, CD27L (CD70), CD30L (CD153), GITRL, CD40L (CD154), LIGHT (CD258), TL1, CD80, CD86, LFA-3 (CD58), SLAM (CD150), CD40, CD28, CD28H, CD2, LFA-3 (CD58), CD48, CD226, DR3, DcR3, FasL, TIM-1 (CD365), PD-1, or active fragment thereof
29. A method of producing the engineered extracellular vesicle or the composition of any one of paragraphs 1-30, comprising:
    (a) providing a population of cells expressing a vector construct encoding one or more sticky binder and one or more signaling domains; and
    (b) isolating a plurality of artificial synapses from the population of cells.
30. A method of producing the engineered extracellular vesicle or the composition of any one of paragraphs 1-30, comprising:
    (a) providing a population of cells expressing a vector construct encoding one or more sticky binder and one or more signaling domains; and
    (b) isolating a plurality of artificial synapses from the population of cells; and
    (c) purifying the plurality of artificial synapses from the population of cells.
33. The method of paragraph 31 or paragraph 32, the isolating is via size exclusion chromatography.
34. The method of paragraph 32, wherein the purifying is via multimodal chromatography.

35. The method of any of paragraphs 31-34, further comprising performing an assay for POI binding to a target polypeptide.
36. The method of paragraph 35, wherein the vector construct further encodes a promoter.
37. The method of paragraph 36, wherein the promoter is a tissue-specific promoter or an inducible promotor.
38. A method of modulating inflammation in a subject, the method comprising:
   administering a composition comprising a plurality of engineered extracellular vesicles to a subject in need thereof,
   wherein the engineered extracellular vesicles comprise at least one fusion polypeptide comprising:
      (i) at least one protein of interest (POI) domain or a fragment thereof and
      (ii) at least one vesicle targeting domain.
39. The method of paragraph 38, wherein the extracellular vesicle comprises an exosome.
40. The method of any one of paragraphs 38-39, further comprising selecting a subject that has or is suspected of having an autoimmune disease or an inflammatory disease or condition.
41. The method of any one of paragraphs 38-40, wherein the vesicle targeting domain is selected from the group consisting of: a Glycosylphosphatidylinositol (GPI) anchor, a fatty acylation site, and a prenylation site.
42. The method of any one of paragraphs 38-41, wherein the vesicle targeting domain is a GPI anchor.
43. The method of any one of paragraphs 38-41, wherein the vesicle targeting domain is C1C2.
44. The method of any one of paragraphs 38-43, wherein the protein of interest (POI) domain comprises one or more of: PD-L1, PD-L2, CTLA-4 (CD152), 4-1BBL (CD137L), HVEM (CD270), FGL1, OX-2 (CD200), Galectin-9, PVR (CD155), Nectin-2 (CD112) isoform alpha, Nectin-2 (CD112) isoform beta, Nectin-2 (CD112) isoform delta, IL-10, TSG-6, B7-H3 (CD276), B7-H4 (VTCN1), B7-H5 (VISTA), B7-H7 (HHLA2), BTNL1, VSIG8, VSIG3 (IGSF11), VSIG4, TIM-3 (HAVCR2), TIM-4 (TIMD4), CEACAM1, BTN3A1, BTN3A2, BTN2A1, BTNL8, BTN2A2, BTN1A1, TIGIT, CD27L (CD70), CD30L (CD153), GITRL, CD40L (CD154), LIGHT (CD258), TL1, CD80, CD86, LFA-3 (CD58), SLAM (CD150), CD40, CD28, CD28H, CD2, LFA-3 (CD58), CD48, CD226, DR3, DcR3, FasL, TIM-1 (CD365), PD-1, or active fragment thereof.
45. The method of any one of paragraphs 38-44, wherein the protein of interest (POI) domain is PD-L1 or a fragment thereof
46. The method of any one of paragraphs 38-44, wherein the protein of interest (POI) domain is PD-L2 or a fragment thereof
47. The method of any one of paragraphs 38-44, wherein the protein of interest (POI) domain is CTLA-4 or a fragment thereof.
48. The method of any one of paragraphs 38-44, wherein the protein of interest (POI) domain is HVEM or a fragment thereof.
49. The method of paragraph 40, wherein the inflammatory disease and/or condition is acute.
50. The method of paragraph 40, wherein the inflammatory related disease and/or condition is chronic.
51. The method of paragraph 38, wherein administering the composition comprises injection, topical administration, or inhalation.
52. Use of a composition comprising a plurality of engineered extracellular vesicles, the engineered extracellular vesicles each comprising:
   at least one fusion polypeptide comprising:
      (i) at least one protein of interest (POI) domain or a fragment thereof; and
      (ii) at least one vesicle targeting domain
   for the treatment of an inflammatory disease or condition.
53. Use of a composition comprising a plurality of engineered extracellular vesicles, the engineered extracellular vesicles each comprising:
   at least one fusion polypeptide comprising:
      (i) at least one protein of interest (POI) domain or a fragment thereof; and
      (ii) at least one vesicle targeting domain
   for the treatment of an autoimmune disease or condition.
54. Use of a composition comprising a plurality of engineered extracellular vesicles, the engineered extracellular vesicles each comprising:
   at least one fusion polypeptide comprising:
      (i) at least one protein of interest (POI) domain or a fragment thereof; and
      (ii) at least one vesicle targeting domain
   for the treatment of cancer.

EXAMPLES

The following examples are provided by way of illustration, not limitation.

Example 1

Design of Artificial Synapse

Figure 1:
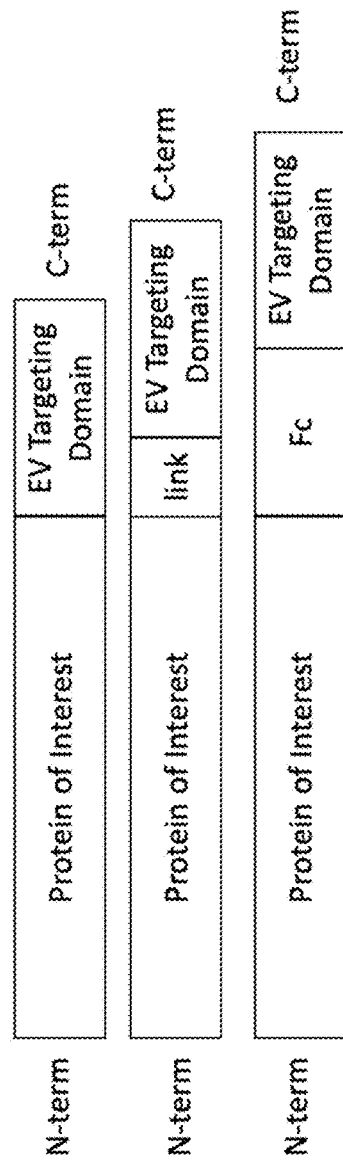

As described, artificial synapses are engineered to induce and propagate biological signaling, including for example, antagonist and agonist signaling. Artificial synapses are designed to include hallmark biophysical and biochemical features of extracellular vesicles, further including vesicle targeting domains and signaling domains. Vesicle targeting domains capable of attaching to extracellular vesicles such as exosomes, signaling domains, optionally including a linker (e.g., Fc linker), can be organized in genetic vector constructs. Designs are shown in FIG. 1.

Sticky binders are extracellular vesicle targeting sequences. Preliminary extracellular vesicle targeting sequences of interest are from, but not limited to, 4F2 (CD98), ADAM10, CD298, TFR2, transmembrane domains of CD9, MARCKS, KRAS, etc. or the like as appreciate by one of ordinary skill in the art. The Inventors discovered high efficiency when proteins are engineered with a GPI domain. Optionally, linker regions such as an Fc linker between the vesicle targeting domains and signaling domains can be added.

A variety of signaling domains are of interest with proof-of-concept examples including PD-L1, PD-L2 and CTLA-4 (CD152). Artificial synapses including these three signaling domains are shown in FIGS. 2-5.

Each of these elements are described in the following non-limiting examples.

Example 2

Genetic Constructs

Examples of constructs including these variable elements (e.g., sticky binders GPI or C1C2, or signaling domains including PD-L1, PD-L2 and CTLA-4 (CD152) were engineered into vectors shown in FIGS. 2-5.

Example 3

Figure 6:
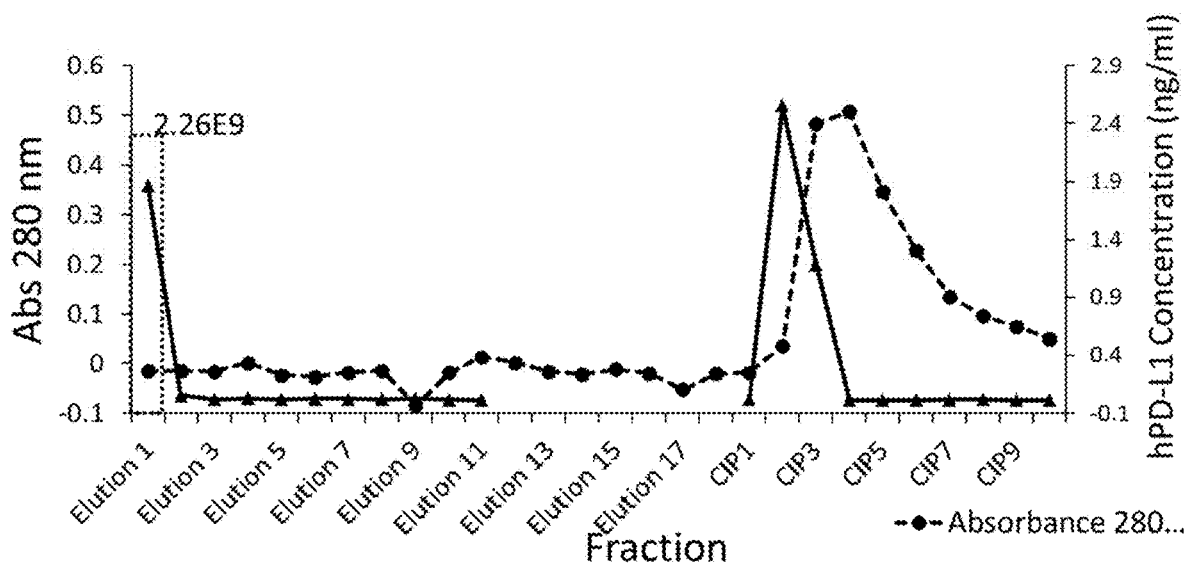

Purification of hPD-L1 Tagged Artificial Synapses by a Multimodal Resin Marketed for Exosome Purification Upon expression of hPD-L1-Fc-GPI in mammalian cells, artificial synapses were further purified using a size exclusion resin marketed for exosome purification. Large MW artificial synapses elute in the first fraction as shown by the high hPD-L1 concentration and exosome quantity (2.26E9 artificial synapses/ml) in elution 1. Clean in place (CIP) fractions show bound and eliminated proteins from the Inventors' exosome elution. Results are shown in FIG. 6.

Example 4 hPDL1-Fc-GPI Exosome Purification—Size Exclusion Chromatography Column

Figure 7:
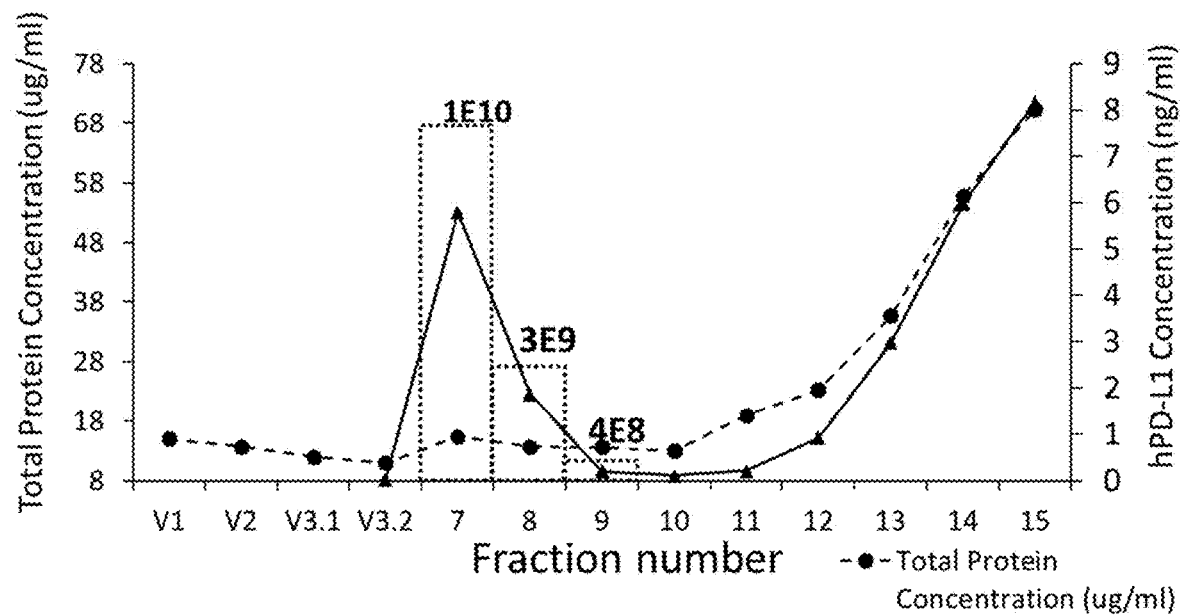

Artificial synapses engineered from exosomes such as hPDL1-Fc-GPI after elution from size exclusion resin marketed for exosome purification can be further purified via a size exclusion column as shown here. Using a size exclusion chromatography (SEC), artificial synapses elute in fractions 7-9. Total protein (determined by qBit) and hPD-L1 ng/ml (determined by ELISA) of each fraction is shown in the graph. Bars show exosome number per ml (i.e. 1E10 artificial synapses/ml etc.). Fractions 7-9 contain >99% purified artificial synapses. Fractions 7-9 are pooled and may be concentrated using a filtration device, for example a 10K MWCO Amicon Centrifugal Filter. Final purified product is filtered through a low protein binding 0.2 µm or 0.45 µm filter, for example a PES filter. Results are shown in FIG. 7.

Example 5 hPD-L1 Expression on Artificial Synapses

Figure 8:
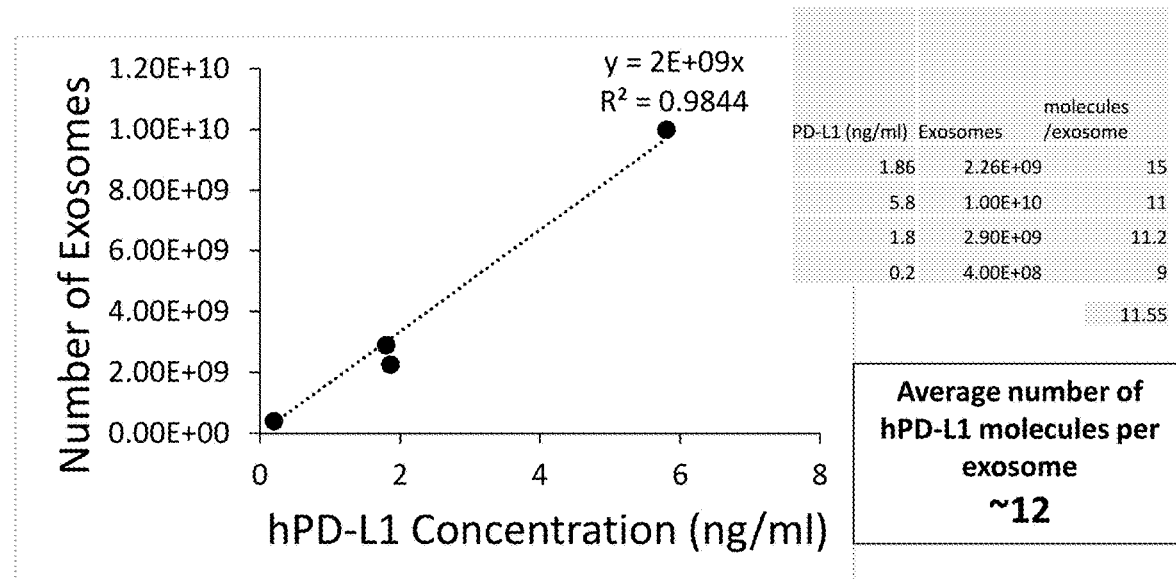

Exosome quantity and hPD-L1 concentration was determined in SEC fractions 7-9. Knowing the molecular weight of engineered hPD-L1, the Inventors can determine the number of hPD-L1 molecules per exosome to be approximately between 12 to 40 PD-L1/exosome. This value is consistent between different purification runs and constructs. Results are shown in FIG. 8.

Example 6

Purification of hPD-L2-Fc-GPI Artificial Synapses Via Multimodal Resin Chromatography Marketed for Exosome Purification This graph shows Abs 280 of multimodal resin chromatography fractions and quantity of hPDL2 in indicated fractions. Artificial synapses eluted in Elution 1.

Figure 9:
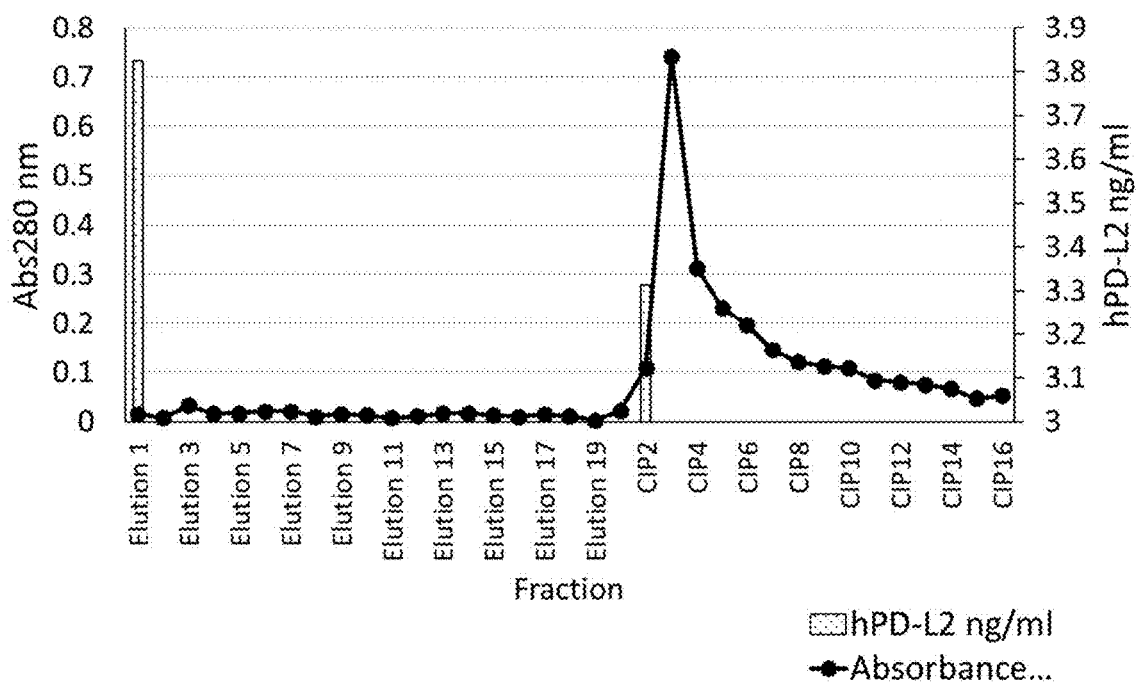

Clean in place (CIP) fractions show bound and eliminated proteins from the Inventors' exosome elution. Results are shown in FIG. 9.

Example 7

PD-L2 Purification Via Size Exclusion Chromatography

Figure 10:
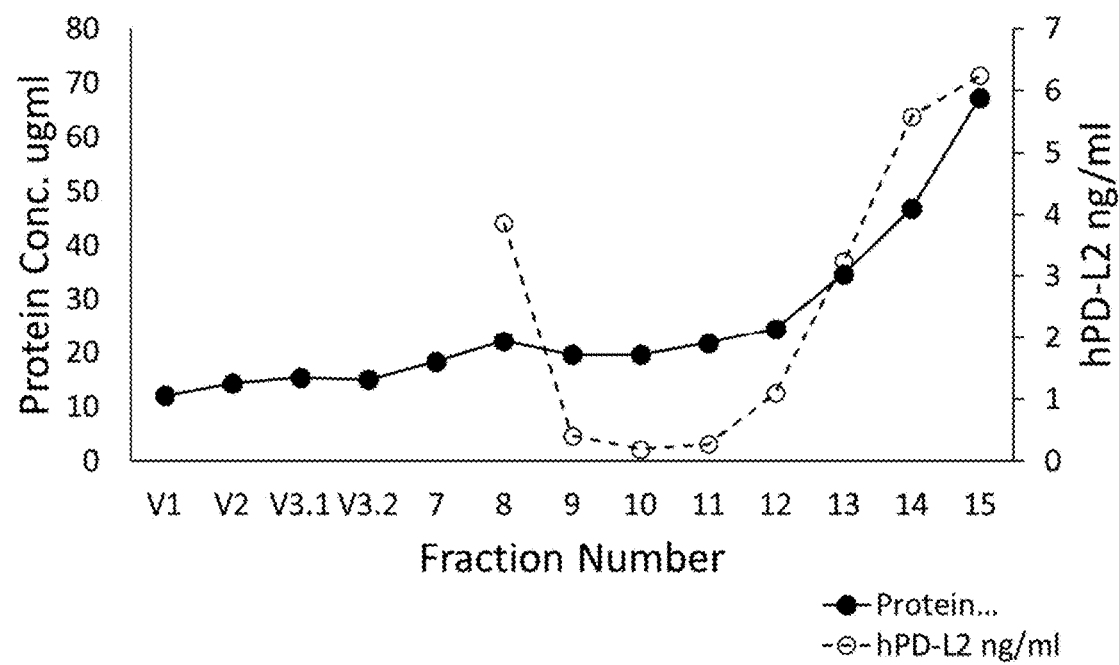

Artificial synapses engineered from artificial synapses such as hPDL2-GPI after elution from size exclusion resin size exclusion resin marketed for exosome purification are further purified via size exclusion chromatography as shown. Results are shown in FIG. 10.

Example 8 hCTLA4-Fc-GPI Exosome Purification Via Size Exclusion Chromatography

Figure 11:
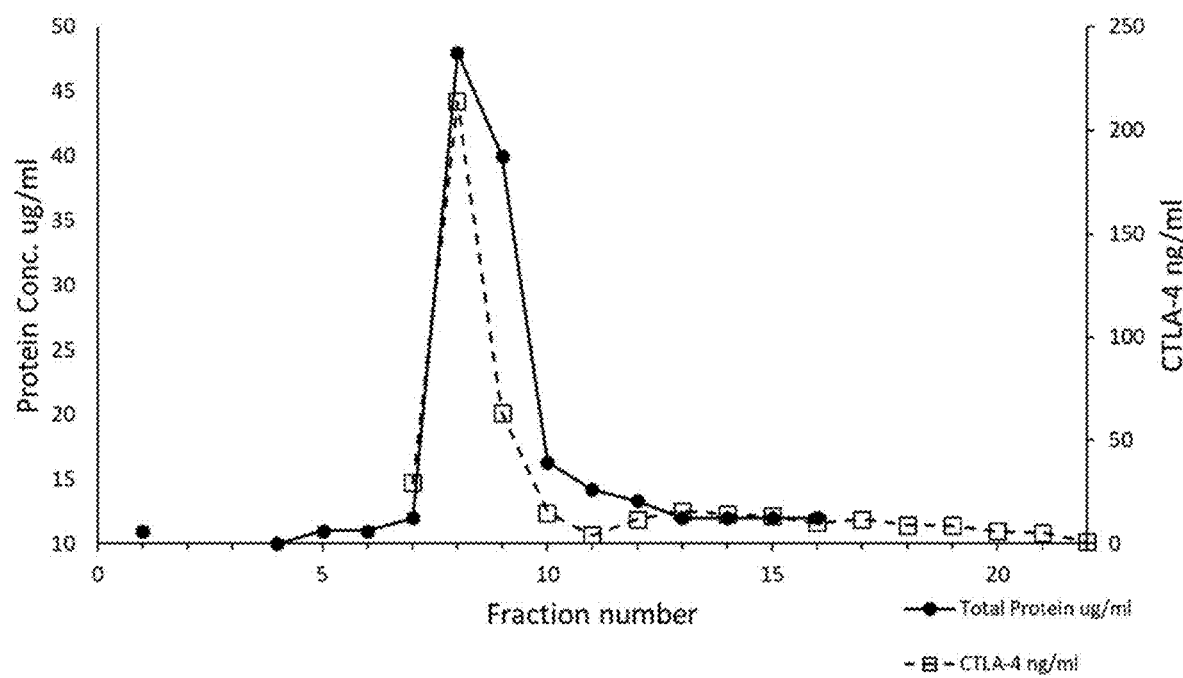

Using size exclusion chromatography marketed for exosome purification, artificial synapses elute in fractions 7-9. Total protein (determined by qBit) and hPD-L1 ng/ml (determined by ELISA) of each fraction is shown in the graph. Fractions 7-9 are pooled and contain >99% purified artificial synapses. Pooled artificial synapses engineered from artificial synapses fractions may then be concentrated using a filtration device, for example a 10K MWCO Amicon. Final purified product is filtered through a low protein binding filter, for example a 0.2 µm or 0.45 µm PES filter. Results are shown in FIG. 11.

Example 9

PD-L1 and PD-L2 In Vitro Assay from DiscoverX

To perform this validation method, the Inventors modified the PathHunter PD-1 Signaling Bioassay from DiscoverX Briefly, the PathHunter PD-1 Signaling Bioassay relies on the well-established PathHunter Enzyme Fragment Complementation (EFC) technology to interrogate receptor activity. EFC consists of a split β-galactosidase (β-gal) enzyme: the Enzyme Donor (ED) and Enzyme Acceptor (EA) fragments which independently have no β-gal activity. However, when forced to complement they form an active β-gal enzyme that will hydrolyze substrate to produce a chemiluminescent signal. The PathHunter PD-1 Signaling Bioassay consists of human cells engineered to stably express an ED-tagged PD-1 receptor, while EA is fused to the phosphotyrosine-binding SH2 domain of the intracellular signaling protein, SHP1. Ligand or antibody-induced activation of the receptor results in phosphorylation of the receptor's cytosolic tail. The SH2-domain fused to EA binds the phosphorylated receptor, forcing complementation of ED and EA, resulting in formation of an active β-gal enzyme, which hydrolyzes the substrate to produce a chemiluminescent signal. Full-length PD-1 receptor was engineered with a small β-gal fragment (ED in red) fused to its C-terminus, and the SH2-domain of SHP1 was engineered with the complementing β-gal fragment (EA). These constructs were stably expressed in Jurkat cells (produced by DiscoverX), while PD-L1 and PD-L2 was stably expressed on artificial synapses produced by Diadem Biotherapeutics. Artificial synapses were engineered to have surface expressed human PD-L1 or PD-L2. Briefly, the gene sequence coding for the extracellular domain of human PD-L1 or PD-L2 was linked to the exosome via a glycosylphosphatidylinositol (GPI) linker with an Fc domain between the linker and PD-L1 or PD-L2 (PD-L1-Fc-GPI and PD-L2-Fc-GPI). Additional variations of the Inventors' PD-L1 and PD-L2 artificial synapses include cloning a C1C2 linker (from MFGE8) in place of the GPI linker, and with or without the Fc domain. The Inventors also cloned murine versions of PD-L1 and PD-L2 extracellular domains in place of the human PD-L1 and PD-L2 all variations. Ligand engagement, through addition of ligand-presenting artificial synapses, results in phosphorylation of PD-1, leading to the recruitment of SHP1-EA The Inventors obtained approximately 1000× higher increase in Relative Light Units (RLU) in Jurkat signaling cells treated with PD-L1 or PD-L2 labeled artificial synapses when compared to soluble PD-L1-Fc or PD-L2-Fc ligand, respectively. Meaning, it took 1000× less ug/ml of PD-L1 or PD-L2 on artificial synapses than solubilized PD-L1-Fc or PD-L2-Fc ligand to achieve the same RLU signaling. Results are shown in FIG. 12.

Example 10

Figure 13B:
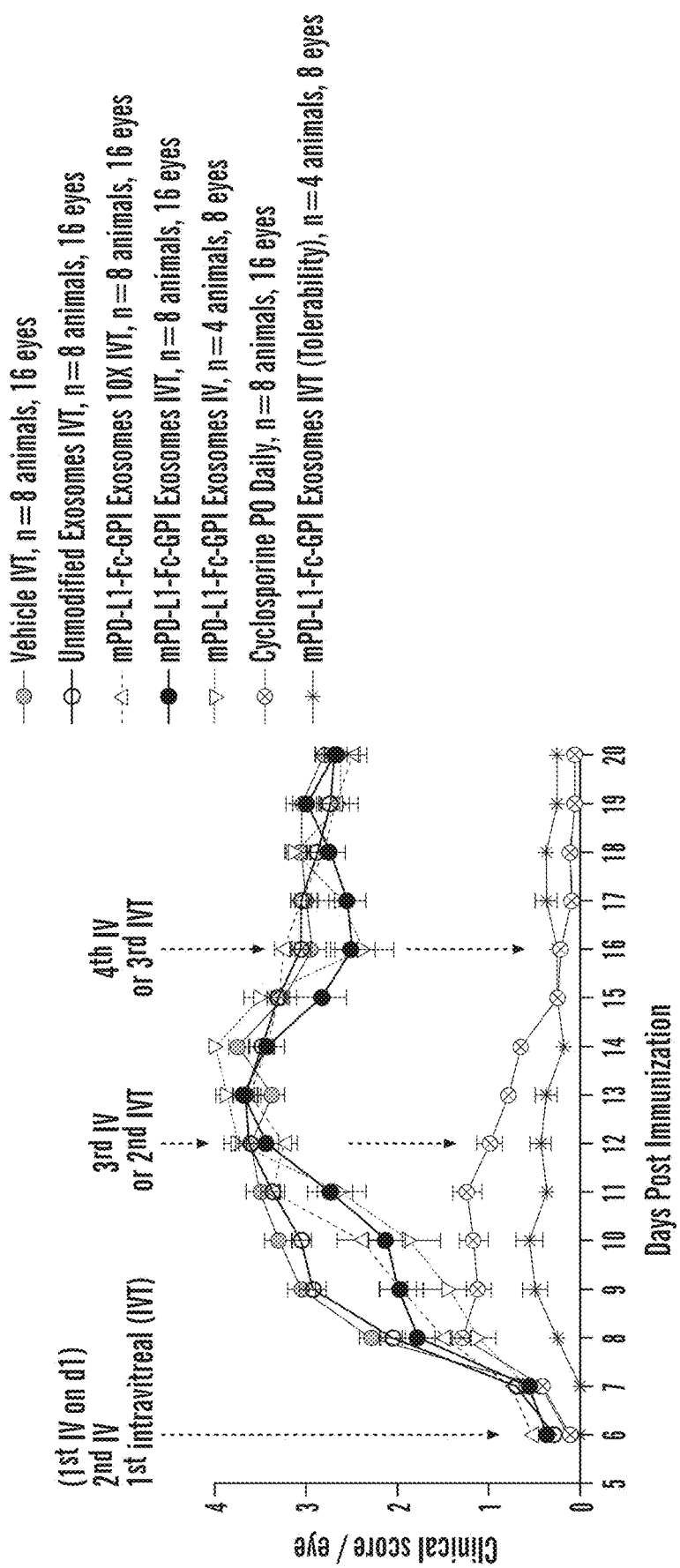

PD-L1 In Vivo Assay—Experimental Autoimmune Uveoretinitis (EAU) in Lewis Rats Bioassay Experimental autoimmune uveoretinitis (EAU) is an organ-specific, T lymphocyte-mediated autoimmune disease, which serves as a model for several human ocular inflammations of an apparently autoimmune nature. There is a statistically significant initial reduction in EAU in mPDL1 artificial synapse treated rats via either the intravitreal and intravenous delivery modes. 2nd intravitreal and 3rd intravenous injections are performed on Day 12. There appears to be a more rapid rate of resolution in the 1× intravitreal and intravenous groups. (C) Simplified view of aforementioned results. (D) Weight of rats was monitored throughout the study. 3rd intravitreal and 4th intravenous injections are performed on Day 16. There does not appear to be any significant change in EAU in any of the test groups. The aforementioned results provide proof of principle of successfully immunizing the rats with human cell derived artificial synapses with mouse PDL1 injected into rats. Results are shown in FIG. 13.

Example 11

Engineered Exosome Multivalent Display

The inventors have developed the following 3 types of protein display on or within exosomes:
  Type I membrane proteins wherein the N-Terminus is on the luminal (interior) side of the exosome membrane and the C-Terminus is on the exterior of the exosome.
  Type II membrane proteins wherein the N-Terminus is on the exterior while the C-Terminus is on the interior.
  Luminal internally loaded proteins which are linked to the exosome by a Myristoylation/Palmitoylation site which attaches proteins to the interior of the exosome membrane.
FIGS. 14-21 demonstrate the various embodiments of the engineered extracellular vesicles.
Additional embodiments or ligands displayed on the exosome surface (Type I and Type II membrane proteins) and internal luminal display can include the following:
  Type I: PD-L1, PD-L2, FGL1, OX40L
  Type II: 4-1BBL, GITRL, CD27L, CD30L
  Luminal: NanoLuc® luciferase; Green fluorescent protein (GFP) (e.g., eGFP, etc.); Red fluorescent protein (RFP) (e.g., mScarlet, mCherry, mRuby, tdTomato, etc.); Cyan fluorescent protein (CFP); Yellow fluorescent protein (YFP); A therapeutic protein; and CRISPR/CAS-9
FIG. 20 shows an exemplary multiple protein display construct. Sequences such as P2A, E2A, F2A, and T2A induce ribosomal slippage which prevent peptide bond formation, meaning that a single mRNA transcript with a 2A sequence will result in two separate peptides after translation. This allows the expression of two separate proteins from one promoter region and thus loading of two proteins on an exosome. Any combination of the proteins of interest domains provided herein can be engineered. Furthermore, a cell line with multiple transgene inserts under separate promoter control. Either method can be used to label Type I, Type II, and luminal display proteins.

Example 12a

Designed and Engineered Human Fusion Polypeptide Constructs

Figure 5A:
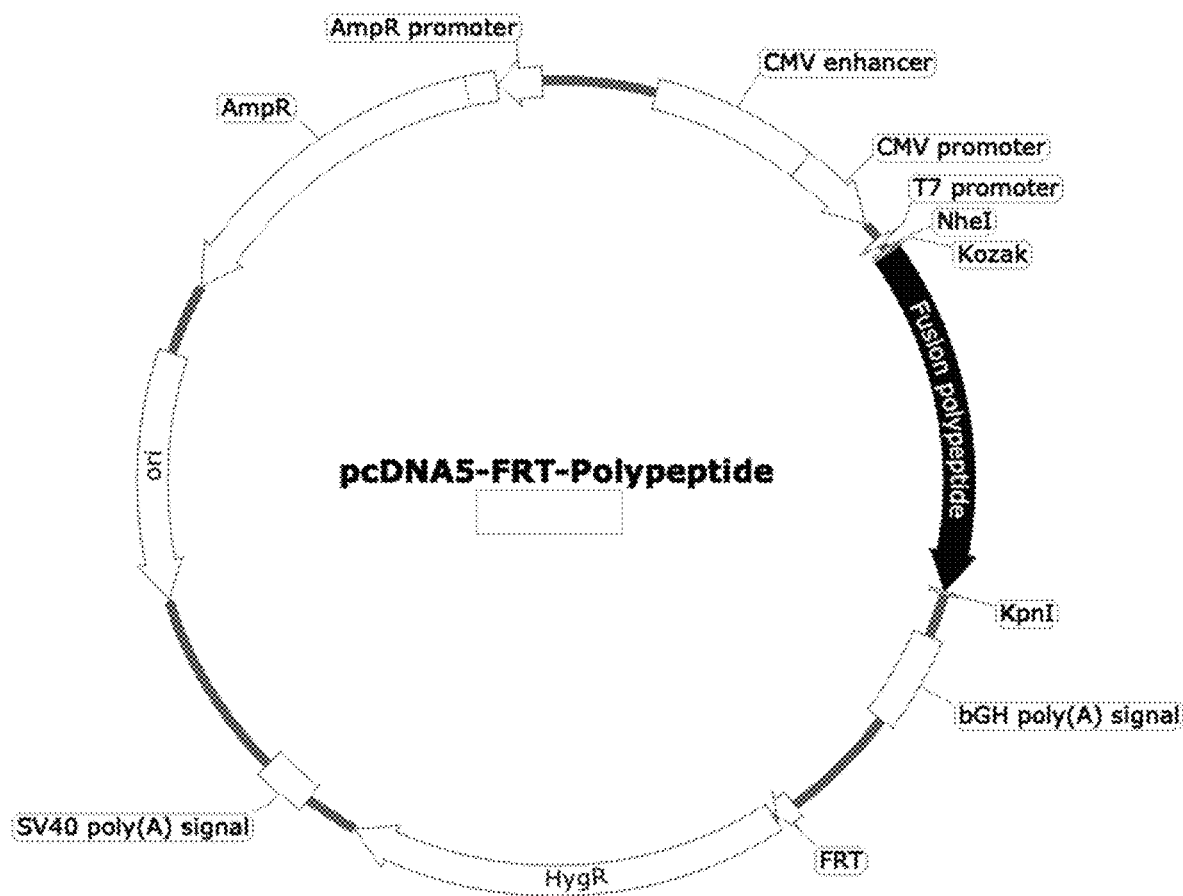
Figure 5B:
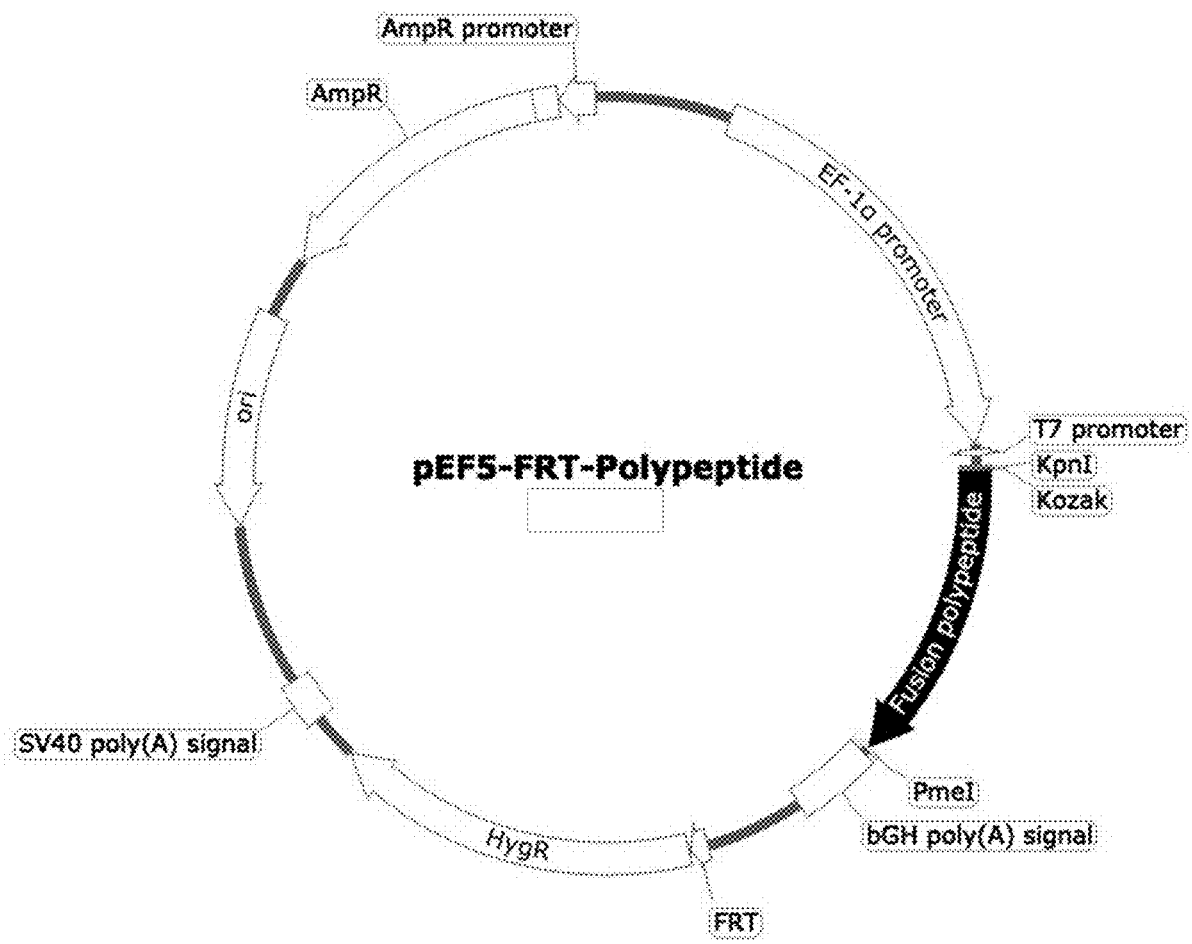

The inventors have designed, engineered, and purified the following human fusion polypeptide constructs for therapeutic use (FIG. 5A-FIG. 5WW):
  pEF5-FRT-hPDL1-C1C2 (FIG. 5I)
  pEF5-FRT-hPDL2-C1C2 (FIG. 5J)
  pEF5-FRT-hPDL1-GPI-P2A-hFGL1-GPI (FIG. 5E)
  pEF5-FRT-hCTLA4-Fc-GPI (FIG. 5C)
  pEF5-FRT-hPDL2-Fc-GPI (FIG. 5H)
  pEF5-FRT-hPD-L1-GPI-P2A-hHVEM-GPI (FIG. 5D)
  pEF5-FRT-hPDL1-GPI (FIG. 5F)
  pcDNA5-FRT-hSecPDL1-GPI (FIG. 5O)
  pcDNA5-FRT-hPDL1-GPI (FIG. 5F)
  pcDNA5-FRT-hPDL1-Link-GPI (FIG. 5T)
  pcDNA5-FRT-4F2-h41BBL (FIG. 5K)
  pcDNA5-FRT-Tfr2-h41BBL (FIG. 5P)
  pEF5-FRT-hPDL1-Fc-GPI (FIG. 5G)
  pcDNA5-FRT-CD9tm3-h41BBL (FIG. 5Q)
  pcDNA5-FRT-hPDL1-Fc-GPI (FIG. 5G)
  pcDNA5-FRT-hPDL1-4Fc-CD9tm2 (FIG. 5RR)
  pcDNA5-FRT-hPDL1-Fc-CD9tm2KRAS (FIG. 5UU)
  pcDNA5-FRT-hPDL1-4Fc-CD9tm2KRAS (FIG. 5SS)
  pcDNA5-FRT-hPDL1-4Fc-GPI (FIG. 5L)
  pcDNA5-FRT-hPDL1-ADAM10 (FIG. 5QQ)
  pcDNA5-FRT-MyrPalm-4F2-h41BBL (FIG. 5R)
  pcDNA5-FRT-MyrPalm-h41BBL (FIG. 5S)
  pcDNA5-FRT-hPDL1-Fc-CD9tm2 (FIG. 5TT)
  pcDNA5-FRT-hSecPDL1-CD9tm4 (FIG. 5W)
  pcDNA5-FRT-hSecPDL1-CD9tm2KRas (FIG. 5V)
  pcDNA5-FRT-hSecPDL1-CD9tm2 (FIG. 5U)
  pcDNA5-FRT-hSecPDL1-CD81 (FIG. 5X)
  pEF5-FRT-hCD200-Fc-GPI (FIG. 5Y)
  pEF5-FRT-hCD200-GPI (FIG. 5BB)
  pEF5-FRT-hTSG6-GPI (FIG. 5FF)
  pEF5-FRT-hPDL2-GPI (FIG. 5EE)
  pEF5-FRT-hFGL-1-GPI (FIG. 5Z)
  pEF5-FRT-hHVEM-GPI (FIG. 5DD)
  pEF5-FRT-hGal9-GPI (FIG. 5CC)
  pEF5-FRT-hHVEM-Fc-GPI (FIG. 5GG), and
  pEF5-FRT-hGal9-Fc-GPI (FIG. 5AA)

Example 12b

Designed and Engineered Fusion Polypeptide Constructs

The inventors have designed, engineered, and purified the following mouse fusion polypeptide constructs for therapeutic use (FIG. 5A-FIG. 5WW):
  pcDNA5-FRT-mPDL1-mFc-CD9tm2KRAS (FIG. 5WW)
  pcDNA5-FRT-mPDL1-mFc-CD9tm2 (FIG. 5VV)
  pcDNA5-FRT-mPDL1-mFc-GPI (FIG. 5NN)
  pcDNA5-FRT-mPDL1-GPI (FIG. 5KK)
  pEF5-FRT-mPDL2-GPI (FIG. 5.OO)
  pEF5-FRT-mPDL1-GPI-P2A-mHVEM-GPI (FIG. 5PP)
  pEF5-FRT-mPDL1-GPI (FIG. 5KK)

pEF5-FRT-mPDL2-Fc-GPI (FIG. 5MM)
pEF5-FRT-mPDL1-Fc-GPI (FIG. 5JJ)
pEF5-FRT-mCTLA4-Fc-GPI (FIG. 5HH)
pEF5-FRT-mPDL1-C1C2 (FIG. 5II); and
pEF5-FRT-mPDL2-C1C2 (FIG. 5LL).

Example 12c

Designed and Engineered Luminal Loaded Fusion Polypeptide Constructs

The inventors have designed, engineered, and purified the following fusion polypeptide constructs for internal luminal loading of the fusion polypeptide:
pcDNA5-FRT-Myr-NanoLuc (FIG. 5M)
pcDNA5-FRT-Myr-mScarlet (FIG. 5N)

Example 13

Purification of Exosomes Labeled with Type I Membrane Fusion Polypeptides

The inventors have purified engineered EVs, including hPD-L1-GPI; hPDL1-Fc-GPI; hPDL2-Fc-GPI; hCTLA4-Fc-GPI; mPDL1-GPI; and mPD-L1-Fc-GPI. The process for purification and analytical processing of the engineered EVs are shown in the flow chart provided in FIG. 21.

Size exclusion chromatography was performed to purify hPD-L1-GPI (no Fc) exosomes (FIG. 24). Protein, RNA and DNA measurements in SEC fractions. Invitrogen Qubit fluorometric assays were used to measure biomolecules from unmodified concentrated cell media SEC fractions or hPD-L1-Exo-Tag concentrated cell media SEC fractions. PD-L1 was measured using an R&D systems PD-L1 ELISA kit. Dot-blot immunoblot analysis of SEC fractions. A 96-well dot blot apparatus was used to immobilize 50 ul of each SEC fraction onto PVDF. Exosome size and concentration was measured in fraction 7 by tunable resistive pulse sensing (TRPS). It was confirmed that GPI anchors the hPD-L1 fusion protein onto the exosomes (FIG. 25).

Furthermore, a commercially available multimodal exosome purification resin was also used to purify and isolate PD-L1-GPI exosomes and PD-L1-Fc-GPI exosomes. Fraction 7 was further analyzed by dot blots (FIG. 28A-28B). In particular, FIG. 28B shows SEC purification results of various embodiments of human PD-L1 displayed on the surface of extracellular vesicles. One embodiment is the hPD-L1-4Fc-GPI (CMV) construct as seen in the top dot blot (stained with rabbit monoclonal anti-PD-L1 antibody). Another embodiment is the hPD-L1-4Fc-GPI (EF1a) as seen in the top dot blot (stained with rabbit monoclonal anti-PD-L1 antibody).

Large MW exosomes elute in the first fraction as shown by the high hPD-L1 concentration and exosome quantity (2.26E9 exosomes/ml) in elution 1. Clean in place (CIP) fractions show bound and eliminated proteins from our exosome elution. Exosome quantity and hPD-L1 concentration was determined in SEC fractions 7-9. Knowing the molecular weight of engineered hPD-L1, we can determine the number of hPD-L1 molecules per exosome to be approximately 12 PD-L1/exosome. This value is consistent between different purification runs and constructs (FIG. 8).

Human hPD-L2 and hCTLA-4-Fc-GPI SEC fractions were purified. In addition, purification of the mouse PD-L1-FcGPI exosomes was performed (FIG. 29). The mouse Fc-PD-L1 expressing exosomes have a higher valency than those that do not comprise the Fc linker.

Example 14

Comparative Proteomics Analysis of the Engineered EVs

Fc-GPI enables high density display and has a higher abundance than endogenous PTGFRN or CD81. Therefore, comparison proteomics of transprotein expression and surface labeling on the engineered exosomes, hPD-L1-Fc-GPI; hPD-L2-Fc-GPI; and hCTLA-Fc-GPI, was performed to determine the effects on endogenous protein expression in engineered exosomes. It was confirmed that the fusion polypeptide expression does not affect the relative expression of native and associated exosome proteins. However, the trans protein may crowd out abundant proteins like CD81 (data not shown).

Example 15

Scale-Up Production and Purification of mPD-L1-Fc-GPI Exosomes Using Microcarriers in a Stirred Tank Single-Use Bioreactor (STR)

1E7 HEK 293 cells were utilized for the production of mPDL1-Fc-GPI exosomes. Cells were passaged on SoloHill® Microcarriers up to Passage 4, at which point cells were expanded in a 2.5 L Stirred Tank Single-Use Bioreactor. Passage 4 cells were cultured for an additional 5 days and media was harvested on Day 5 and used for exosome purification. The general aim and process is provided below
AIM: Utilize SoloHill's Xeno-free microcarrier technology to scale up cells for engineering EVs and evaluate Microcarrier-stir tank bioreactor technology for production of therapeutic exosomes in the Xeno-free medium conditions.
Passage 1:
Thaw vial (1.00E+07) of cells and seed Corning T-150 & CellSTACK2 tissue culture treated flask at 1.00E+04 cells per cm2 seed density.
Perform 100% medium exchange from both flasks on day 3.
Harvest Corning T-150 & CellSTACK2 flasks on day 4 post seeding and seed spinner microcarrier culture.
Passage 2:
Expand cells in 2×200 mL spinner flasks at 10 cm2/mL microcarrier density using SoloHill's Xeno-free prototype microcarrier.
Seed microcarrier cultures at 1.00E+04 cells per cm2 seed density and T-25 as flatware control flask.
Perform 80% batch volume medium exchange from spinners and T-25 flasks on day 3.
Harvest both microcarrier and T-25 flasks on day 4 post seeding and seed spinner microcarrier culture.
Passage 3:
Expand cells in 3×300 mL spinner flasks at 10 cm2/mL microcarrier density using SoloHill's Xeno-free prototype microcarrier.

293

Seed microcarrier cultures at 1.00E+04 cells per cm2 seed density and T-25 as flatware control flask.
Perform 80% batch volume medium exchange from spinners and T-25 flasks on day 3.
Harvest both microcarrier and T-25 flasks on day 4 post seeding.
Seed microcarrier—stir tank bioreactor for exosome production.
Passage 4:
Expand cells into a 2.5 L microcarrier-stir tank at 10 cm2/mL surface area to medium ratio.
Seed cultures at 1.00E+04 cells per cm2 seed density and T-25 as flatware control flask.
Perform 80% batch volume medium exchange on day 2.
On day 3 rinse all cultures with 2× cell culture volumes of DPBS containing Ca and Mg.
Add exosome production medium (DMEM-1% Glutamax) to all cultures at 10 cm2/mL surface area to medium volume ratio.
On day 5 collect harvest spent medium from all cultures, filter using 0.45 μm Nalgene rapid flow system and freeze at −20° C.
Procedures:
Medium Composition
DMEM 1× (Corning ref #10-013-CV)
1% Glutamax (Thermo ref #35050061)
3% Human platelet lysate (Stemulate from Cook Reagentec PG-NH-500)
Cell Harvest Protocol for Planar Culture
Settle microcarriers and remove maximum volume of spent medium without removing microcarriers.
Wash microcarrier culture with DPBS 2× time at 0.1 mL/cm2 volume to surface area ratio.
Add 37° C. warmed TrypLE 5× enzyme at 0.012 mL/cm2 and incubate flask at room temperature for ~15 minutes.
Add complete medium at 0.024 mL/cm2 to quench TrypLE 5× activity.
Perform viable cell count using NC200 cell count instrument.
Nuclei Count Protocol for Microcarrier Culture
Obtain 4-5 mL of microcarrier culture from bioreactor or spinner flask
Settle microcarriers and remove maximum volume of spent medium without removing microcarriers.
Add 1.5 mL Nucleocounter Reagent A to macrocarrier sample tube and vortex at high speed for a minute.
Add 1.5 mL Nucleocounter Reagent B to macrocarrier sample tube and vortex at high speed for a minute.
Perform nuclei count using NC200 nuclei count instrument.
Medium Collection from STR Bioreactor
Stop all controls and settle microcarriers in the bioreactor vessel.
Pump out medium through screen bag into collection bottle at 200 mL/minute flowrate using peristaltic pump.
Inside BSC pour medium into 0.45 μm Nalgene rapid flow filter system and remove free floating cells.
Freeze medium bottles in minus 20° C. freezer.
Medium Collection from Spinner Flasks
Inside BSC pour microcarrier culture into 0.45 μm Nalgene rapid flow filter system and remove free floating cells as well as microcarriers.
Freeze medium bottles in minus 20° C. freezer.

294

| Cell culture set points | | | | |
| --- | --- | --- | --- | --- |
| Temperature ° C. | Agitation rpm | Dissolved Oxygen (DO) % | pH | Incubator CO$_2$ setting % |
| T-Flask 37 | n/a | n/a | n/a | 5 ± 1 |
| CellSTACK 2 37 | n/a | n/a | n/a | 5 ± 1 |
| Spinner flask 37 | 35 | n/a | n/a | 5 ± 1 |
| STR bioreactor 37 | 35 | 50 | 7.35 | n/a |

FIG. 31 shows mPDL1-Fc-GPI production, growth parameters, and analyte concentrations from a 2.6 L culture in a Stirred Tank Single-Use (STR) bioreactor. Day 2: 80% batch volume medium was exchanged ($1^{st}$ increase in glucose and decreased in lactate) Day 3: rinse culture with 2× cell culture volumes of DPBS containing Ca and Mg. ($2^{nd}$ increase in glucose and decreased in lactate). Add exosome production medium (DMEM-1% Glutamax) to culture at 10 cm$^2$/mL surface area to medium volume ratio.

mPDL1 was purified using the purification process outlined above (FIGS. 32-33).

Example 16

PD-L1-Fc-GPI and PDL2-Fc-GPI Exosomes Increase PD-1 Signaling

Figure 12A:
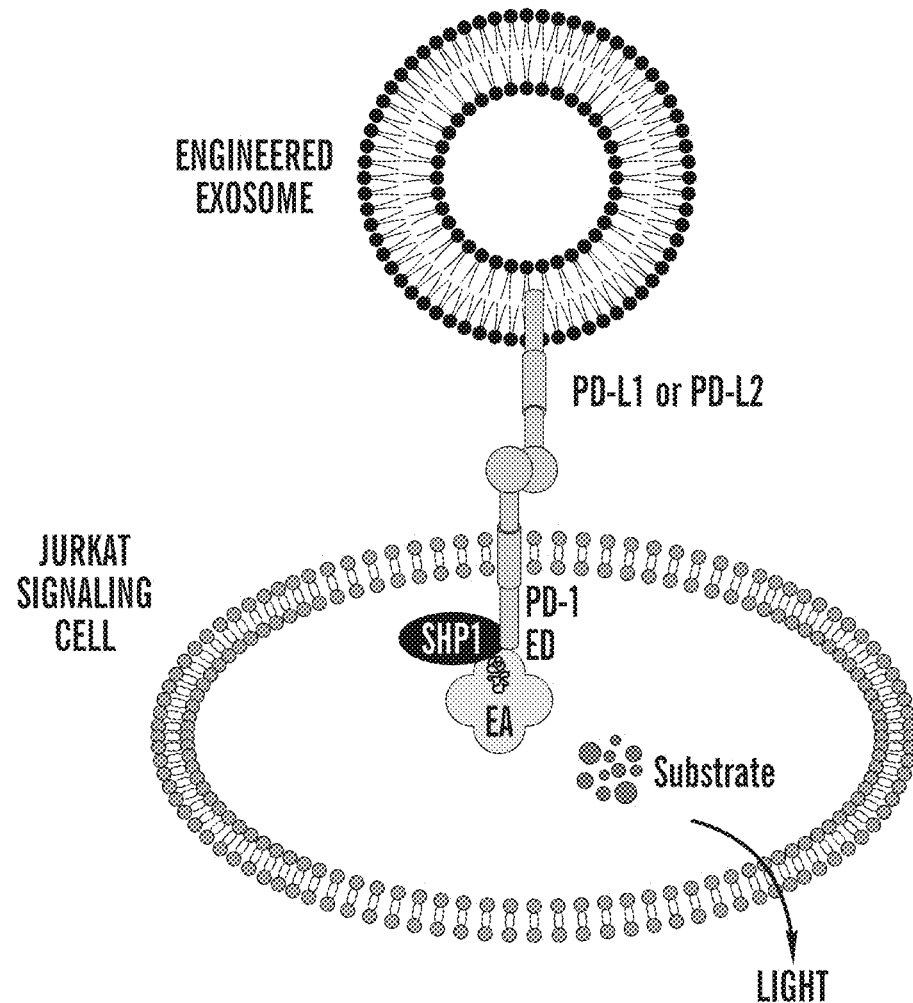
Figure 12B:
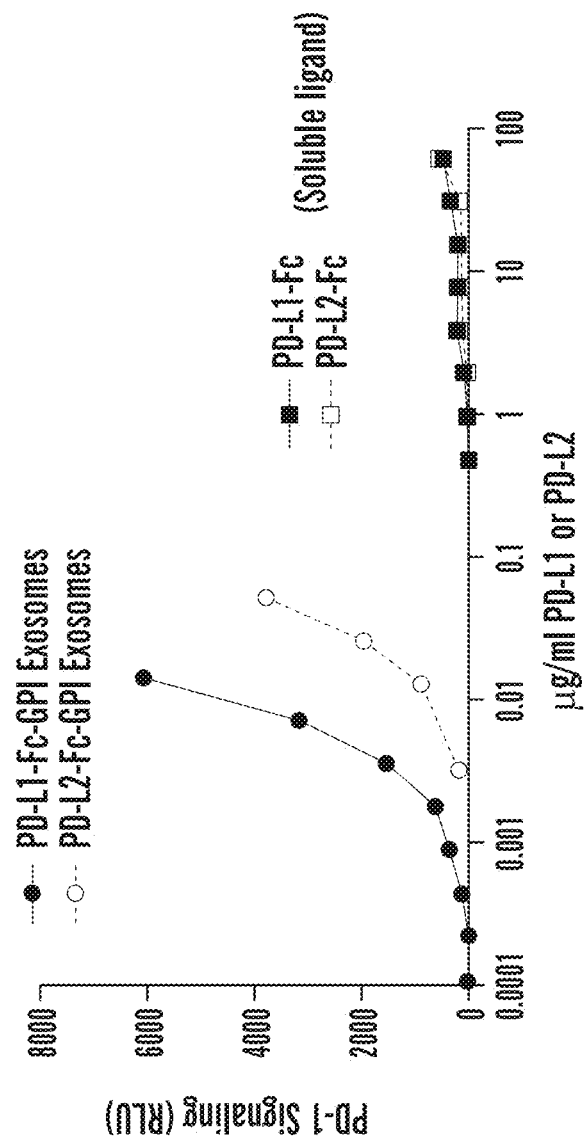

The purified exosomes were tested using the modified DiscoverX Assay in FIG. 12A. Approximately a 1000× increase in Relative Light Units (RLU) was achieved for Jurkat signaling cells treated with PD-L1 or PD-L2 labeled exosomes when compared to soluble PD-L1-Fc or PD-L2-Fc ligands alone, respectively. Therefore, it takes 1000× less mg/ml of PD-L1 or PD-L2 on the engineered exosomes to activate PD-1 over solubilized ligands, PD-L1-Fc or PD-L2, achieve the same RLU signaling. FIG. 12B show a dose-response curves for the PD-L1 and PD-L2 exosomes vs soluble PD-L1 and PD-L2 signaling bioassay. FIG. 12B shows dose-response curves for the PD-L1 and PD-L2 exosomes comprising an Fc linker and GPI sticky binder vs. soluble ligands with an Fc domain linker. These results show that the PD-L1 and PD-L2 polypeptides fused with the Fc and GPI domains on EVs have a more potent effect on PD-1 signaling than the soluble ligands alone.

Example 17

In Vivo Assay—Therapeutic Effect of mPD-L1 Exosomes in an Experimental Autoimmune Uveoretinitis (EAU) Model in Lewis Rats Lewis rats were challenged with retinal antigen interphotoreceptor retinoid-binding protein (IRBP) peptide. This model can be used to study anterior and posterior chamber dependent EAU. Rats were immunized on Day 1 with EAU presenting typically at Day 6. Clinical scores in the rat were determined. The EAU dosing schedule is shown in FIG. 13A. EAU dosing test article are shown in the following table.

| EAU dosing test articles | | | | |
|---|---|---|---|---|
| | Unmodified Exosomes (IVT) | mPD-L1-Fc-GPI Exosomes 1X (IVT) | mPD-L1-Fc-GPI Exosomes 10X (IVT) | mPD-L1 Exosomes (IV) |
| Dose | 2 ul | 2 ul | 2 ul | 5 ml/kg |
| Total protein concentration | 40 ug/ml | 40 ug/ml | 400 ug/ml | 40 ug/ml |
| Total protein administered | 80 ng/eye | 80 ng/eye | 800 ng/eye | 50 ug/animal |
| Exosome concentration | $5.7 \times 10^{10}$/ml | $2.34 \times 10^{10}$/ml | $2.34 \times 10^{11}$/ml | $2.34 \times 10^{10}$/ml |
| Total exosomes administered | $4.7 \times 10^{7}$ | $4.7 \times 10^{7}$ | $4.7 \times 10^{8}$ | $2.93 \times 10^{10}$ |

*IVT-intravitreal, IV-intravenous

The study design is outlined below:

| Group | Test Article | N | Route | Concentration | Dosage | Regimen |
|---|---|---|---|---|---|---|
| 1 | Cyclosporine | 8 | p.o. | 1 mg/mL | 10 mg/kg | BID from day 0 to Day 20 |
| 2 | Negative control (PBS vehicle) | 8 | Intravitreal both eyes | 1× | 2-3 μL | Day 6, Day 12, and Day 16 |
| 3 | Unmodified exosomes (Control exosomes) | 8 | Intravitreal both eyes | 1× (~40 ug/ml) | 2-3 μL | Day 6 and Day 12 |
| 4 | mPD-L1-Fc-GPI (40 ug/ml) | 8 | Intravitreal both eyes | 1× (~40 ug/ml) | 2-3 μL | Day 6, Day 12, and Day 16 |
| 5 | mPD-L1-Fc-GPI (40 ug/ml) | 4 | Intravenous Injection | 1× (~40 ug/ml) | 5 mL/kg | Day 1, Day 6, Day 12, and Day 16 |
| 6 | No IRBP peptide but treated with Test Agent B (for tolerability) | 4 | Intravitreal both eyes | 1× (~40 ug/ml) | 2-3 μL | Day 6, Day 12, and Day 16 |
| 7 | mPD-L1-Fc-GPI (400 ug/ml) | 8 | Intravitreal both eyes | 1× (400 ug/ml) | 2-3 μL | Day 6, Day 12, and Day 16 |

Clinical Scores were determined as follows:

| EAU Clinical Scores in Rats | |
|---|---|
| Score | Clinical Criteria |
| 0 | No disease; eye is translucent and reflects light(red reflex) |
| 0.5 (trace) | Dilated blood vessels in the iris |
| 1 | Engorged blood vessels in the iris; abnormal pupil contraction |
| 2 | Hazy anterior chamber;decreased red reflex |
| 3 | Moderately opaque anterior chamber,but pupil still visible; dull red reflex |
| 4 | Opaque anterior chamber and obscured pupil; red reflex absent; proptosis |

Each higher grade includes the criteria of the preceding one.

Each higher grade includes the criteria of the preceding one.

Figure 13C:
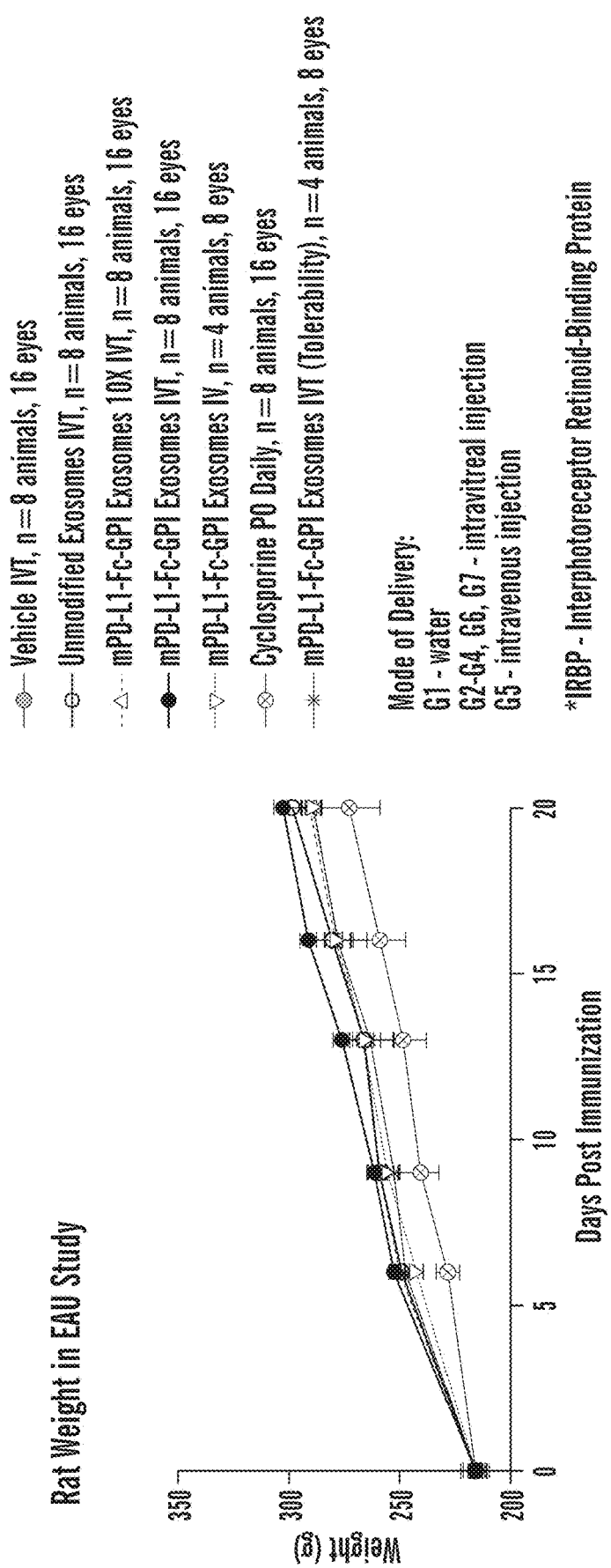
Figure 14:
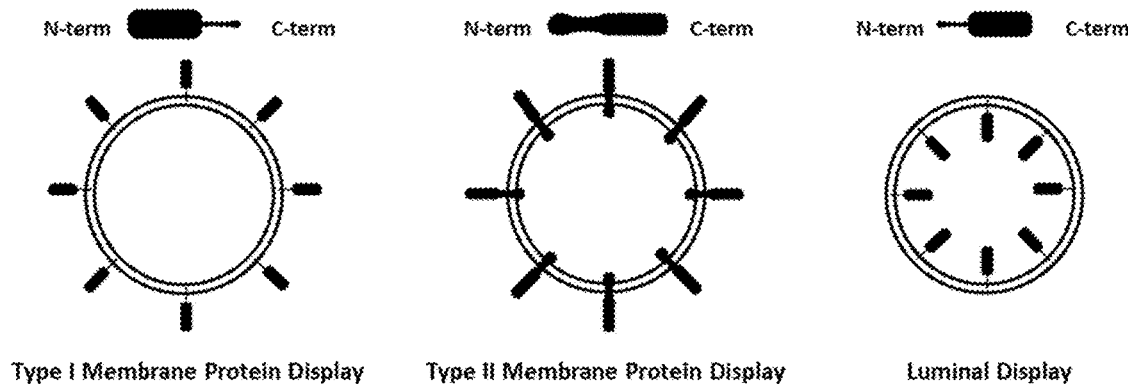
Figure 15:
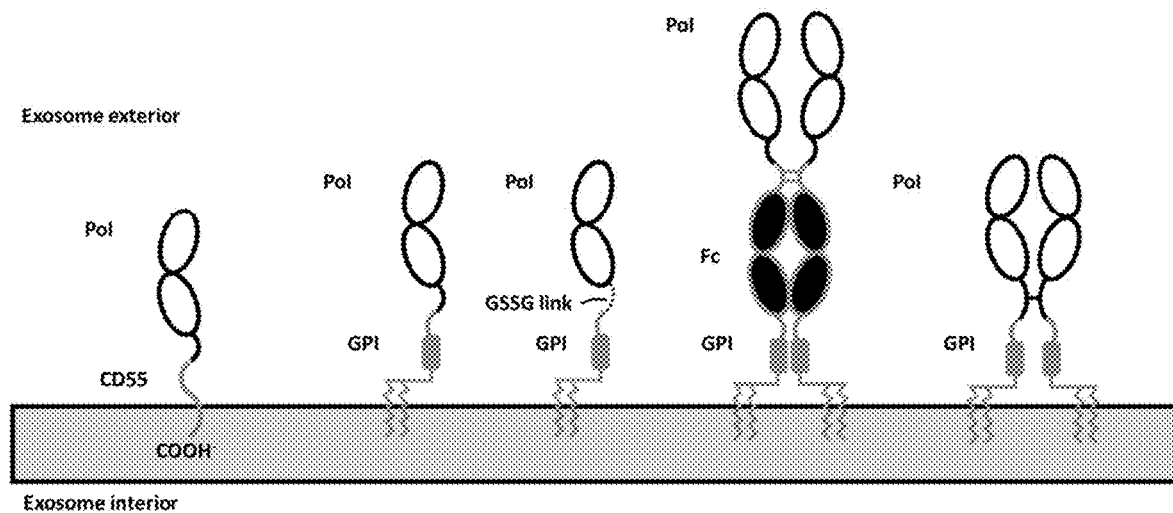
Figure 16:
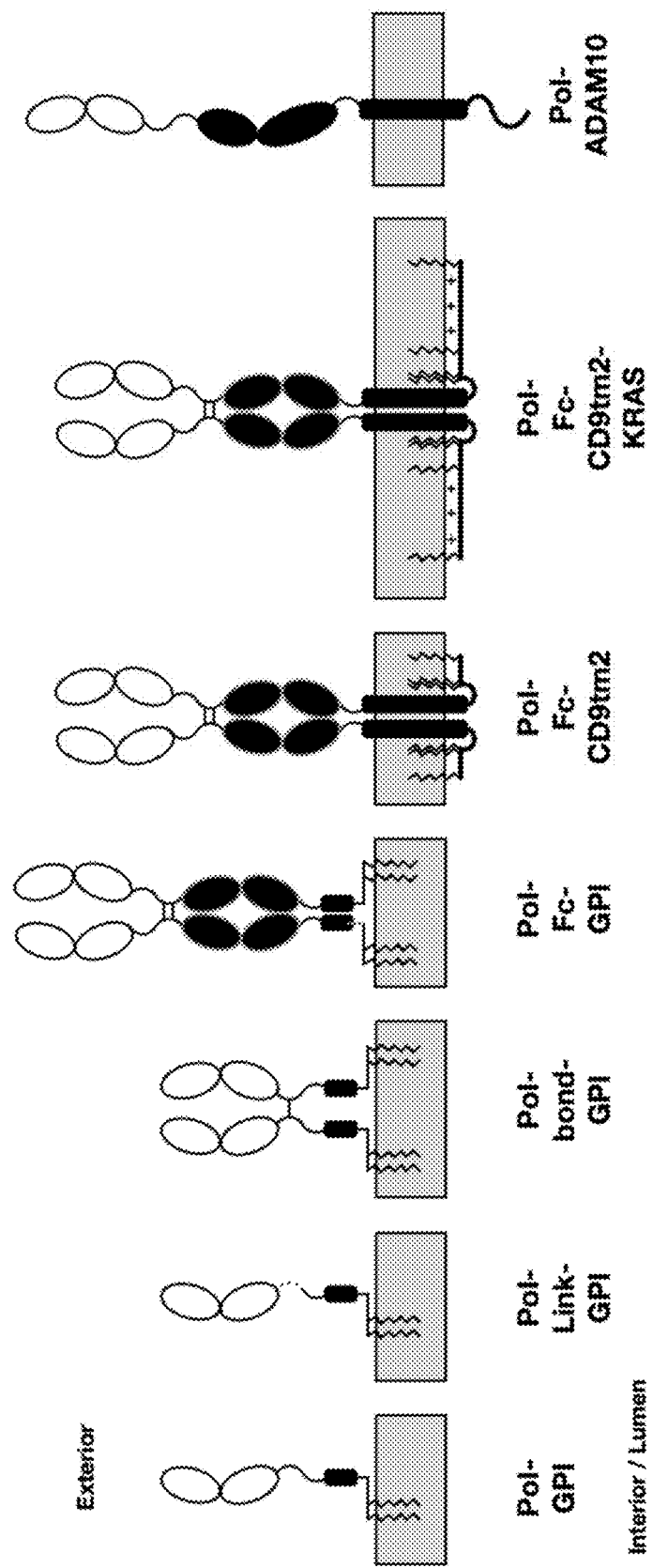
Figure 17:
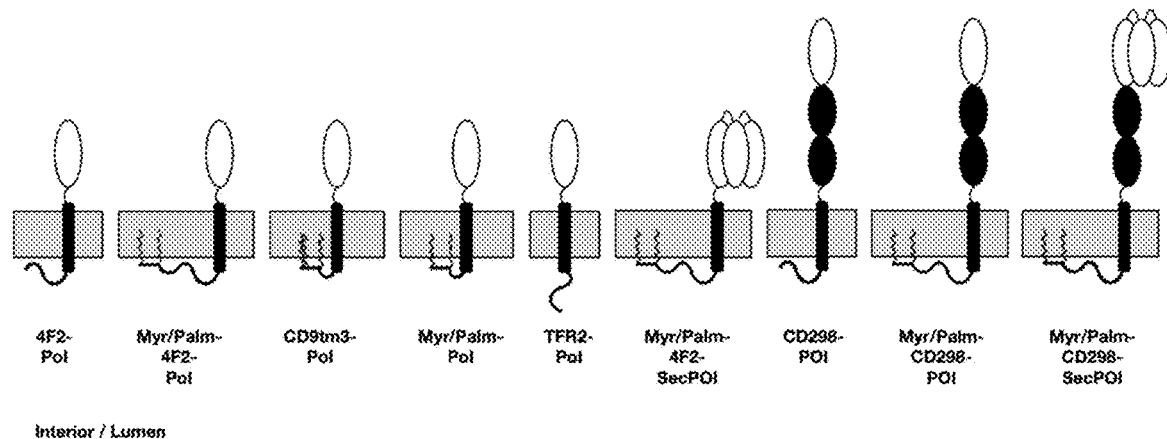
FIG. 17 shows a schematic representation of the surface of an exosome engineered with an extracellular portion of the Type II membrane protein of interest (POI) with transmembrane/exosome targeting domains.
Figure 18:
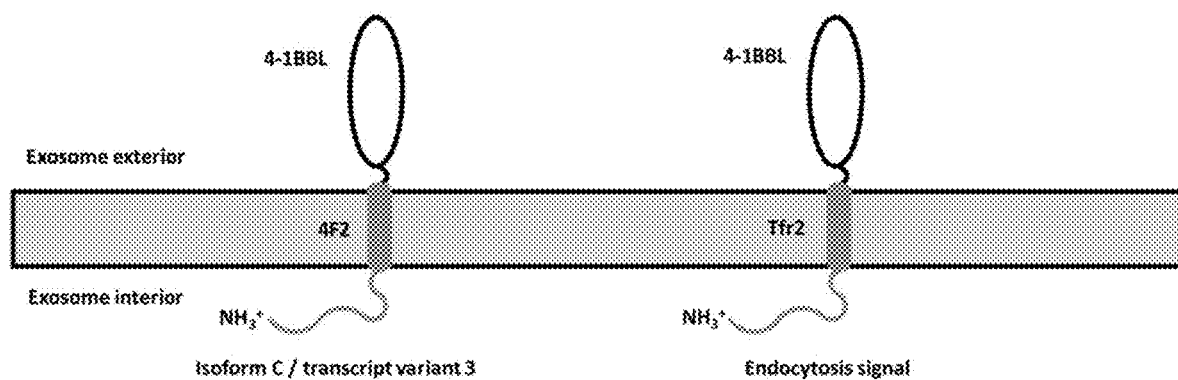
FIG. 18 shows a schematic representation of an exosome engineered with an extracellular portion of the Type II membrane protein 4-1BB.

It was discovered that there is a statistically significant initial reduction in EAU in mPDL1 exosome treated rats via either the intravitreal and intravenous delivery modes as compared with untreated animals (FIG. 13A). Rat weight did not change post immunization (FIG. 13C).

Example 18

Purification of Exosomes Labeled with Type II Membrane Proteins

The inventors designed, engineered, and purified pcDNA5-FRT-4F2-4-1BBL exosomes by the methods provided herein (FIG. 34). Several embodiments of the 4-1BBL labeled exosomes are shown in FIG. 35. Cell expression of the 4F2-4-1BBL was confirmed (data not shown). FIGS. 36A-36B shows the purification of 4F2-4-1BBL exosomes.

Example 19

Purification of Luminal Labeled Exosomes (Internal Loading)

In addition to Type I and Type II display fusion proteins on the surface of an EV, exosomes can be loaded with fusion proteins that are localized to the lumen of the phospholipid bilayer of the exosome (FIG. 37). The Myr/Palm sequence used herein when fused to mScarlet the fusion protein into the luminal interior of extracellular vesicles. Fluorescence at an excitation wavelength 470 nm and emission wavelength of 665-720 nm peaks in SEC fractions 7, 8, and 9. SEC fractions 7, 8, and 9 contain exosomes as demonstrated by the dot blot. Fraction 8 was further analyzed for exosome quantification using an ExoView system (FIG. 38). Unmodified exosomes do not show fluorescence. Exosomes show near 80% loading with Myr/Palm-mScarlet. The remaining 20% were out of the detection limit. Thus, nearly 100% internal loading was achieved using the specific Myr/Palm sequence.

NanoLuc luciferase expressing exosomes were also purified with the Myr/Palm sequence incorporated into the vector encoding the fusion polypeptide. A Qubit fluorometer was used to measure total protein and Promega Nano-Glo substrate and plate luminometer to measure luminescence (FIG. 39A). Tetraspanin characterization of exosomes was performed and determined that the NanoLuc luciferase exosomes were internally loaded and purified in fraction 8 (FIG. 39B).

SEQUENCE LISTING (321 sequences)

SEQ ID NO: 1 - DNA, 3634 bp, Homo sapiens
agttctgcgcagcttcccgaggctccgcaccagccgcgcttctgtccgcctgcagggcattccagaaagatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatccca

SEQ ID NO: 2 - protein, 290 aa, Homo sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 3 - DNA, 3653 bp, Mus musculus
gaaatcgtggtccccaagcctcatgccaggctgcacttgcacgtcgcgggccagtctcctcgcctgcagatagttcccaaaacatgaggatatttgctggcattatattcacagcctgctgtcacttgctacgggcgtttactatcacggctccaaaggacttgtacgtggtggagtatggcagcaacgtcacgatggagtgcagattccctgtagaacgggagctggacctgcttgcgttagtggtgtactgggaaaaggaagatgagcaagtgattcagtttgtggcaggagaggaggaccttaagcctcagcacagcaacttcagggggagagcctcgctgccaaaggaccagcttttgaagggaaatgctgcccttcagatcacagacgtcaagctgcaggacgcaggcgtttactgctgcataatcagctacggtggtgcggactacaagcgaatcacgctgaaagtcaatgccccataccgcaaaatcaaccagagaatttccgtggatccagccacttctgagcatgaactaatatgtcaggccgagggttatccagaagctgaggtaatctggacaaacagtgaccaccaacccgtgagtgggaagagaagtgtcaccacttcccggacagaggggatgcttctcaatgtgaccagcagtctgagggtcaacgccacagcgaatgatgttttctactgtacgttttggagatcacagccagggcaaaaccacacagcggagctgatcatcccagaactgcctgcaacacatcctccacagaacaggactcactgggtgcttctgggatccatcctgttgttcctcattgtagtgtccacggtcctcctcttcttgagaaaacaagtgagaatgctagatgtggagaaatgtggcgttgaagatacaagctcaaaaaaccgaaatgatacacaattcgaggagacgtaagcagtgttgaaccctctgatcgtcgattggcagcttgtggtctgtgaaagaaagggcccatgggacatgagtccaaagactcaagatggaacctgagggagagaaccaagaaagtgttgggagaggagcctggaacaacggacattttttccagggagacactgctaagcaagttgcccatcagtcgtcttgggaaatggattgagggttcctggcttagcagctggtccttgcacagtgaccttttcctctgctcagtgccgggatgagagatggagtcatgagtgttgaagaataagtgccttctatttattttgagtctgtgtgttctcactttgggcatgtaattatgactggtgaattctgacgacatgatagatcttaagatgtagtcaccaaactcaactgctgcttagcatcctccgtaactactgatacaagcagggaacacagaggtcacctgcttggtttgacaggctcttgctgtctgactcaaataatctttatttttcagtcctcaaggctcttcgatagcagttgttctgtatcagccttataggtgtcaggtatagcactcaacatctcatctcattacaatagcaaccctcatcaccatagcaacagctaacctctgttatcctcacttcatagccaggaagctgagcgactaagtcacttgcccacagagtatcagctctcagatttctgttcttcagccactgtcctttcaggatagaatttgtcgttaagaaattaatttaaaaactgattattgagtagcattgtatatcaatcacaacatgccttgtgcactgtgctggcctctgagcataaagatgtacgccggagtaccggtcggacatgtttatgtgtgttaaatactcagagaaatgttcattaacaaggagcttgcattttagagacactggaaagtaactccagttcattgtctagcattacatttacctcatttgctatccttgccatacagtctcttgttctccatgaagtgtcatgaatcttgttgaatagttcttttattttttaaatgtttctatttaaatgatattgacatctgaggcgatagctcagttggtaaaaccctttcctcacaagtgtgaaaccctgagtcttatccctagaacccacataaaaaacagttgcgtatgtttgtgcatgcttttgatcccagcactagggaggcagaggcaggcagatcctgagctctcattgaccacccagcctagcctacatggttagctccaggcctacaggagctggcagagcctgaaaaacgatgcctagacacacacacacacacacacacacacacacacacacacacacaccatgtactcatagacctaagtgcaccctcctacacatgcacacacatacaattcaaacacaaatcaacagggaattgtctcagaatggtccccaagacaaagaagaagaaaaacaccaaaccagctctattccctcagcctatcctctctactccttcctagaagcaactactattgtttttgtatataaatttacccaacgacagttaatatgtagaatatatattaaagtgtctgtcaatatatattatctctttctttctttcttcctttctttctttctttctttctttctttctttctttctttctttctttcttccttccttccttccttccttccttccttccttcctttctttctttctttctttttttctgtctatctgtacctaaatggttgctcactatgcattttctgtgctcttcgccctttttatttaatgtatggatatttatgctgcttccagaatggatctaaagctctttgtttctaggttttctcccccatccttctaggcatctctcacactgtctaggccagacaccatgtctgctgcctgaatctgtagacaccatttataaagcacgtactcaccgagtttgtatttggcttgttctgtgtctgattaaagggagaccatgagtccccagggtacactgagttaccccagtaccaagggggagccttgtttgtgtctccatggcagaagcaggcctggagccattttggtttcttccttgacttctctcaaacacagacgcctcacttgctcattacaggttctcctttgggaatgtcagcattgctccttgactgctggctgccctggaaggagcccattagctctgtgtgagcccttgacagctactgcctctccttaccacaggggcctctaagatactgttacctagaggtcttgaggatctgtgttctctggggggaggaaaggaggaggaacccagaactttcttacagttttccttgttctgtcacatgtcaagactgaaggaacaggctgggctacgtagtgagatcctgtctcaaaggaaagacgagcatagccgaacccccggtggaaccccctctgttacctgttcacacaagcttattgatgagtctcatgttaatgtcttgtttgtatgaagtttaagaaaatatcgggttgggcaacacattctatttattcattttatttgaaatcttaatgccatctcatggtgttggattggtgtggcactttattcttttgtgttgtgtataaccataaattttattttgcatcagattgtcaatgtattgcattaatttaataaatatttttatttattaaaaaaaaaaaaaaaaa

SEQ ID NO: 4 - protein, 290 aa, Mus musculus
MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTHWVLLGSILLFLIVVSTVLLFLRKQVRMLDVEKCGVEDTSSKNRNDTQFEET

SEQ ID NO: 5 - DNA, 2432 bp, Homo sapiens
actctcatgttacggcaaaccttaagctgaatgaacaacttttcttctcttgaatatatcttaacgccaaattttgagtgcttttttgttacccatcctcatatgtcccagctagaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatatcaaatacagaacatgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttggctgcttcacattttcatccccttctgcatcattgctttcattttcatagccacagtgatagccctaagaaaacaactctgtcaaaagctgtattcttcaaaagacacaacaaaaagacctgtcaccacaacaaagagggaagtgaacagtgctatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttcaacgttctttatatattctacttttgggta

SEQ ID NO: 6 - protein, 273 aa, Homo sapiens
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 7 - DNA, 3415 bp, Mus musculus
gaccacatcatttttgttccctttgttggatatatcctaatgtcaaatgtggcatatctttgttgtctccttctgtctcccaactagagagaacacacttacggctcctgtcccgggcaggtttggttgtcggtgtgattggcttccagggaacctgatacaaggagcaactgtgtgctgccttttctgtgtctttgcttgaggagctgtgctgggtgctgatattgacacagaccatgctgctcctgctgccgatactgaacctgagcttacaacttcatcctgtagcagctttattcaccgtgacagcccctaaagaagtgtacaccgtagacgtcggcagcagtgtgagcctggagtgcgattttgaccgcagagaatgcactgaactggaagggataagagccagtttgcagaaggtagaaaatgatacgtctctgcaaagtgaaagagccaccctgctggaggagcagctgcccctgggaaaggctttgttccacatccctagtgtccaagtgagagattccgggcagtaccgttgcctggtcatctgcggggccgcctgggactacaagtacctgacggtgaaagtcaaagcttcttacatgaggatagacactaggatcctggaggttccaggtacaggggaggtgcagcttacctgccaggctagaggttatcccctagcagaagtgtcctggcaaaatgtcagtgttcctgccaacaccagccacatcaggacccccgaaggcctctaccaggtcaccagtgttctgcgcctcaagcctcagcctagcagaaacttcagctgcatgttctggaatgctcacatgaaggagctgacttcagccatcattgaccctctgagtcggatggaacccaaagtccccagaacgtggccacttcatgttttcatcccggcctgcaccatcgctttgatcttcctggccatagtgataatccagagaaagaggatctaggggaagctgtattacggaagaagatctggacctgcggtcttgggagttggaaggatctgatgggaaaccctcaagagacttctggactcaaagtgagaatcttgcaggacctgccatttgcacttttgaaccctttggacggtgacccagggctccgaagaggagcttgtaagactgacaatcttccctctgtctcaagactctctgaacagcaagaccccaatggcactttagacttacccctgggatcctggaccccagtgagggcctaaggctcctaatgactttcagggtgagaacaaaaggaattgctctccgccccacccccacctcctgctttccgcagggagacatggaaattcccagttactaaaatagattgtcaatagagttatttatagccctcatttcctccggggacttggaagcttcagacagggtttttcataaacaaagtcataactgatgtgttttacagcatcctagaatcctggcagcctctgaagttctaattaactggaagcatttaagcaacacgttaagtacccccactgtggtatttgtttctacttttctgtttttaaagtgtgagtcacaaggtaattgttgtaacctgtgatatcactgtttcttgtgtctcttctttcaactacatcttttaaaacaaaacggtgtggggtttggttgttttggtggtagtggtagtgtttctcagtggtatctccttaagaaaaaaaatcatcatgccagtgaattgtttcttcagccatttcagatgggaagctggaatagcctgtcccccaagctaagccttcttccctagctttctgcgtgattttacattgagcattcctgttgctttgtttctataactgtaatgtggtgatgtcattgttagggcacttgagggtgggcgttctggaagtcctttcaggttagtgtttgggggcagggttgctcagaatacataaaggtgctaacttaaactgcagccatggagctcagtgaattcactaaccttcgggctgtccaaatgtgcacattagctactgtgacccctgtaggttagggagcctgaagccagctctttacctggtgtttagactcagcagaatttggagtcaatgggaccaaatggttgtgaaattaagatttgaagtgtgcatcttattttatcaccatctgcccaacaaaacttcagaaaatgcctttgaagcacaaaaatgtaatcgtttatgtgaaatctctgagttgcatttagatgcccattgcagcaaggtggctctctcacagattccacaccttagcctaagataccagacagcaggacagagagaaaagtccttcctggtgtgcaaacttccttacactggacctcgcctctcaggtgtgtgattggtaggccaaatcccgatagccaatcggtgttgggtgctttgtctgctctactgggagtccagtggtacaatggattctggcaaaatgctgccatcttggccctcgctgggctgctttctaggatattcatagagaaagggccgtccagatccagtatcctaaaatcctgagaggagaatataagttagtgtgtctcactataactatctctatgatcggtcacattactatctaacagttaccaaatactatatgcctaatactggtaagcattttatacacaccattggattgaatcctctcaaaatcctcaaaaaggaagttattaatacctccataggcaaggagcccagaacccagagaggtcaggcagtctagttatagatgcctgctttgtttagaagtgaacaagagcatcaaattattaatgtgccctggttattaatgcgccctggttacctgctggatggaacatcaaggtggacttttggcagttgcatacacccagaggtattttggctattcacggattaatttcacacgaagtgtttcagagacatgtgtaggggaagtccgggttcagggggcctaagattcaaactctagcttagctacgtctgacctccctaagcactaacttactatcaaaagaatgagcagtaaaagaatggtgtttactgcctgcctttatcaggcagtgaacgtgcagcgggcaacgaatgcttgataagtgtgtgtcagtgtgaagtcccatgtaccagccgctgtccccactgcaaaagcagcagagcgctcagacatcatcagctgatttaccagcagcagatttcttcttctagtcccatccctgaagaagcttccagcctaggtacattgcatgggctttgtgctccaggagttcctacacagccctcaacttcaacacaggcaaagtgcttactgatcctcatgtatcttacagggtcccctctacccacaatacctcattgctggaacttcaaatcttcctgaataaaagcttgcccgtggtttaatta

SEQ ID NO: 8 - protein, 247 aa, Mus musculus
MLLLLPILNLSLQLHPVAALFTVTAPKEVYTVDVGSSVSLECDFDRRECTELEGIRASLQKVENDTSLQSERATLLEEQLPLGKALFHIPSVQVRDSGQYRCLVICGAAWDYKYLTVKVKASYMRIDTRILEVPGTGEVQLTCQARGYPLAEVSWQNVSVPANTSHIRTPEGLYQVTSVLRLKPQPSRNFSCMFWNAHMKELTSAIIDPLSRMEPKVPRTWPLHVFIPACTIALIFLAIVIIQRKRI

SEQ ID NO: 9 - DNA, 1997 bp, Homo sapiens
gctttctattcaagtgccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttccgga

SEQ ID NO: 10 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 11 - DNA, 1933 bp, Mus musculus
ctacacatatgtagcacgtaccttggatcaaagctgtctatataaagtccccgagtctgtgtgggttcaaacacatctcaaggcttctggatcctgttgggttttactctgctccctgaggacctcagcacatttgccccccagccatggcttgtcttggactccggaggtacaaagctcaactgcagctgccttctaggacttggccttttgtagccctgctcactcttcttttcatcccagtcttctctgaagccatacaggtgacccaaccttcagtggtgttggctagcagccatggtgtcgccagctttccatgtgaatattcaccatcacacaacactgatgaggtccgggtgactgtgctgcggcagacaaatgaccaaatgactgaggtctgtgccacgacattcacagagaagaatacagtgggcttcctagattaccccttctgcagtggtacctttaatgaaagcagagtgaacctcaccatccaaggactgagagctgttgacacgggactgtacctctgcaaggtggaactcatgtacccaccgccatactttgtgggcatgggcaacgggacgcagatttatgtcattgatccagaaccatgcccggattctgacttcctcctttggatccttgtcgcagttagcttggggttgtttttttacagtttcctggtcactgctgtttctttgagcaagatgctaaagaaaagaagtcctcttacaacaggggtctatgtgaaaatgcccccaacagagccagaatgtgaaaagcaatttcagccttattttattcccatcaactgaaaggccgtttatgaagaagaaggagcatacttcagtctctaaaagctgaggcaatttcaactttccttttctctccagctatttttacctgtttgtatattttaaggagagtatgcctctctttaatagaaagctggatgcaaaattccaattaagcatactacaatttaaagctaaggagcatgaacagagagctgggatatttctgttgtgtcagaaccattttactaaaagcatcacttggaagcagcataaggatatagcattatggtgtggggtcaagggaacattagggaatggcacagcccaaagaaaggaagggggtgaaggaagagattatattgtacacatcttgtatttacctgagagatgtttatgacttaaataatttttaaatttttcatgctgttattttctttaacaatgtataattacacgaaggtttaaacatttattcacagagctatgtgacatagccagtggttccaaaggttgtagtgttccaagatgtatttttaagtaatattgtacatgggtgtttcatgtgctgttgtgtatttgctggtggtttgaatataaacactatgtatcagtgtcgtcccacagtgggtcctggggaggtttggctggggagcttaggacactaatccatcaggttggactcgaggtcctgcaccaactggcttggaaactagatgaggctgtcacagggctcagttgcataaaccgatggtgatggagtgtaaactgggtctttacactcattttattttttgtttctgcttttgttttcttcaatgatttgcaaggaaaccaaaagctggcagtgtttgtatgaacctgacagaacactgtcttcaaggaaatgcctcattcctgagaccagtaggtttgtttttttaggaagttccaatactaggaccccctacaagtactatggctcctcgaaaacacaaagttaatgccacaggaagcagcagatggtaggatgggatgcacaagagttcctgaaaactaacactgttagtgttttttttttaactcaatattttccatgaaaatgcaaccacatgtataatatttttaattaaataaaagtttcttgtgattgtttt

SEQ ID NO: 12 - protein, 223 aa, Mus musculus
MACLGLRRYKAQLQLPSRTWPFVALLTLLFIPVFSEAIQVTQPSVVLASSHGVASFPCEYSPSHNTDEVRVTVLRQTNDQMTEVCATTFTEKNTVGFLDYPFCSGTFNESRVNLTIQGLRAVDTGLYLCKVELMYPPPYFVGMGNGTQIYVIDPEPCPDSDFLLWILVAVSLGLFFYSFLVTAVSLSKMLKKRSPLTTGVYVKMPPTEPECEKQFQPYFIPIN

SEQ ID NO: 13 - DNA, 1634 bp, Homo sapiens
agtctctcgtcatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataacgtccagcctgggtgcagcccacctggacagagtccgaatcctactccatccttcatggagacccctggtgctgggtccctgctgctttctctacctcaaggggcttggcaggggtccctgctgctgacctccccttgaggaccctcctcacccactccttccccaagttggaccttgatatttattctgagcctgagctcagataatatattatatatattatatatatatatatatttctatttaaagaggatcctgagtttgtgaatggacttttttagaggagttgttttgggggggggggggtcttcgacattgccgaggctggtcttgaactcctggacttagacgatcctcctgcctcagcctcccaagcaactgggattcatcctttctattaattcattgtacttatttgcttatttgtgtgtattgagcatctgtaatgtgccagcattgtgcccaggctagggggctatagaaacatctagaaatagactgaaagaaaatctgagttatggtaatacgtgaggaatttaaagactcatccccagcctccacctcctgtgtgatacttgggggctagcttttttctttctttcttttttttgagatggtcttgttctgtcaaccaggctagaatgcagcggtgcaatcatgagtcaatgcagcctccagcctcgacctcccgaggctcaggtgatcctcccatctcagcctctcgagtagctgggaccacagttgtgtgccaccacacttggctaactttttaatttttttgcggagacggtattgctatgttgccaaggttgtttacatgccagtacaatttataataaacactcatttttcctccc

SEQ ID NO: 14 - protein, 254 aa, Homo sapiens
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 15 - DNA, 1230 bp, Mus musculus
ataaagcacgggcactggcgggagacgtgcactgaccgaccgtggtaatggaccagcacacacttgatgtggaggataccgcggatgccagacatccagcaggtacttcgtgcccctcggatgcggcgctcctcagagataccgggctcctcgcggacgctgcgctcctctcagatactgtgcgccccacaaatgccgcgctccccacggatgctgcctaccctgcggttaatgttcgggatcgcgaggccgcgtggccgcctgcactgaacttctgttcccgccacccaaagctctatggcctagtcgctttggttttgctgcttctgatcgccgcctgtgttcctatcttcacccgcaccgagcctcggccagcgctcacaatcaccacctcgcccaacctgggtacccgagagaataatgcagaccaggtcacccctgtttcccacattggctgccccaacactacacaacagggctctcctgtgttcgccaagctactggctaaaaaccaagcatcgttgtgcaatacaactctgaactggcacagccaagatggagctgggagctcatacctatctcaaggtctgaggtacgaagaagacaaaaaggagttggtggtagacagtcccgggctctactacgtatttttggaactgaagctcagtccaacattcacaaacacaggccacaaggtgcagggctgggtctctcttgttttgcaagcaaagcctcaggtagatgactttgacaacttggccctgacagtggaactgttcccttgctccatggagaacaagttagtggaccgttcctggagtcaactgttgctcctgaaggctggccaccgcctcagtgtgggtctgagggcttatctgcatggagcccaggatgcatacagagactgggagctgtcttatcccaacaccaccagctttggactctttcttgtgaaacccgacaacccatgggaatgagaactatccttcttgtgactcctagttgctaagtcctcaagctgctatgttttatggggtctgagcaggggtcccttccatgactttctcttgtctttaactggacttggtatttattctgagcatagctcagacaagactttatataattcactagatagcattagtaaactgctgggcagctgctagataaaaaaaaatttctaaatcaaagtttatatttatattaatatataaaaataaatgtgtttgt

SEQ ID NO: 16 - protein, 309 aa, Mus musculus
MDQHTLDVEDTADARHPAGTSCPSDAALLRDTGLLADAALLSDTVRPTNAALPTDAAYPAVNVRDREAAWPPALNFCSRHPKLYGLVALVLLLLIAACVPIFTRTEPRPALTITTSPNLGTRENNADQVTPVSHIGCPNTTQQGSPVFAKLLAKNQASLCNTTLNWHSQDGAGSSYLSQGLRYEEDKKELVVDSPGLYYVFLELKLSPTFTNTGHKVQGWVSLVLQAKPQVDDFDNLALTVELFPCSMENKLVDRSWSQLLLLKAGHRLSVGLRAYLHGAQDAYRDWELSYPNTTSFGLFLVKPDNPWE

SEQ ID NO: 17 - DNA, 1702 bp, Homo sapiens
ataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcggaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaa

SEQ ID NO: 18 - protein, 283 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 19 - DNA, 893 bp, Mus musculus
gctcttggcctgaagtttcttgatcaagaaaatggaacctctcccaggatgggggtcggcaccctggagccaggcccctacagacaacaccttcaggctggtgccttgtgtcttccttttgaacttgctgcagcgcatctctgcccagccctcatgcagacaggaggagttccttgtgggagacgagtgctgccccatgtgcaacccaggttaccatgtgaagcaggtctgcagtgagcatacaggcacagtgtgtgccccctgtcccccacagacatataccgcccatgcaaatggcctgagcaagtgtctgccctgcggagtctgtgatccagacatgggcctgctgacctggcaggagtgctccagctggaaggacactgtgtgcagatgcatcccaggctacttctgtgagaaccaggatgggagccactgttccacatgcttgcagcacaccacctgccctccagggcagagggtagagaagagagggactcacgaccaggacactgtatgtgctgactgcctaacagggaccttctcacttggagggactcaggaggaatgcctgccctggaccaactgcagtgcatttcaacaggaagtaagacgtgggaccaacagcacagacaccacctgctcctcccaggtcgtctactacgttgtgtccatccttttgccacttgtgatagtgggagctgggatagctggattcctcatctgcacgcgaagacacctgcacaccagctcagtggccaaggagctggagcctttccaggaacaacaggagaacaccatcaggtttccagtcaccgaggttgggtttgctgagaccgaggaggagacagcctccaactgaacaaattctgggtgacaagacaccgaggagacgt

SEQ ID NO: 20 - protein, 275 aa, Mus musculus
MEPLPGWGSAPWSQAPTDNTFRLVPCVFLLNLLQRISAQPSCRQEEFLVGDECCPMCNPGYHVKQVCSEHTGTVCAPCPPQTYTAHANGLSKCLPCGVCDPDMGLLTWQECSSWKDTVCRCIPGYFCENQDGSHCSTCLQHTTCPPGQRVEKRGTHDQDTVCADCLTGTFSLGGTQEECLPWTNCSAFQQEVRRGTNSTDTTCSSQVVYYVVSILLPLVIVGAGIAGFLICTRRHLHTSSVAKELEPFQEQQENTIRFPVTEVGFAETEEETASN

SEQ ID NO: 21 - DNA, 1237 bp, Homo sapiens
aatgcagttacaggatcctgggaagcagagtgtctggatggaacctgagctgggtctctgactcacttctgactttagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaata

SEQ ID NO: 22 - protein, 312 aa, Homo sapiens
MAKVFSFILVTTALTMGREISALEDCAQEQMRLRAQVRLLETRVKQQQVKIKQLLQENEVQFLDKGDENTVIDLGSKRQYADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 23 - DNA, 1120 bp, Mus musculus
gttagaagttcctgggaggctctgtgtggatggactgagcctagctaagtcctgattcattttgacttgagttctctcagtgggaagaatgggaaagatttacagcttcgtcctggtcgccattgctctgatgatgggaagggaaggttgggccctcgagagtgagaactgcttgcgggagcaggtgaggctcagggctcaggtgcaccagcttgagacccgggtcaaacaacaacagaccatgattgcacagctcttgcatgagaaggaagtccagtttctggataaaggatcggagaacagtttcattgaccttggaggcaagaagcagtatgcagattgttcagagatttacaatgacggatttaagcagagtggattttacaaaatcaaacctcttcagagcctggcagaattctctgtttattgtgacatgtctgatggagggggatggactgtaattcagagacgatctgatggcagtgagaactttaacaggggttggaatgactatgaaaatggctttggaaactttgtccaaaacaatggcgaatactggctgggtaacaaaaacattaacttgctaactattcaaggagactacactttaaaaatcgacctgacagattttgagaaaaacagcagcttcgcacaataccaaagttttaaagttggtgataaaaagtctttttatgaactaaatattggagaatattctggcacagctggagattccctgtcaggaacttttcatcctgaagtacagtggtgggctagtcaccaaaggatgaagttcagcacgtgggacagagataacgacaattaccaaggaaactgtgctgaggaagagcagtctggctggtggtttaacaggtgtcactctgcaaacctgaacggtgtttactaccgtggttcctacagggcagaaacggataatggtgttgtgtggtacacctggcatgggtggtggtattccttgaaatctgtggttatgaaaattaggccaagtgattttattccaaatattatttagttgccctcattgggatctcctttctgtaattcatcttggtttacttgaaaataaatatttgaaaaagatataattctgaataacaca

SEQ ID NO: 24 - protein, 314 aa, Mus musculus
MGKIYSFVLVAIALMMGREGWALESENCLREQVRLRAQVHQLETRVKQQQTMIAQLLHEKEVQFLDKGSENSFIDLGGKKQYADCSEIYNDGFKQSGFYKIKPLQSLAEFSVYCDMSDGGGWTVIQRRSDGSENFNRGWNDYENGFGNFVQNNGEYWLGNKNINLLTIQGDYTLKIDLTDFEKNSSFAQYQSFKVGDKKSFYELNIGEYSGTAGDSLSGTFHPEVQWWASHQRMKFSTWDRDNDNYQGNCAEEEQSGWWFNRCHSANLNGVYYRGSYRAETDNGVVWYTWHGWWYSLKSVVMKIRPSDFIPNII

SEQ ID NO: 25 - DNA, 2129 bp, Homo sapiens
agagctccaggcgcacatccgcagtcagccacctcgcgcgcgcctccaggagcaaggatggagaggctggtgatcaggatgcccttctctcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatagcaagattttcatgtgttatttaattctgtattgtttcttatatttgtagtaaaatattgaacaattaaaagtgttgactccaaa

SEQ ID NO: 26 - protein, 269 aa, Homo sapiens
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 27 - DNA, 2363 bp, Mus musculus
gggcgtggttggttggtcgtctcttcctccacactagaggagctgtagagtctgcctgtgcagtggagggggctctctctacggcgaatagtagtgtccctgctcacaggtgttgcggagatatcctccatcgtggaagagctcagaccccgagaagctggtgtctagctgcggcccagagcaaggatgggcagtctggtattcaggagacctttctgccatctctccacctacagcctgatttggggcatggcagcagtagcgctgagcacagctcaagtggaagtggtgacccaggatgaaagaaaggcgctgcacacaactgcatccttacgatgttctctaaaaacatcccaggaacccttgattgtgacatggcagaaaaagaaagccgtgagcccagaaaacatggtcacctacagcaaaacccatggggttgtaatccagcctgcctacaaagacaggataaatgtcacagagctgggactctggaactcaagcatcaccttctggaacacaacattggaagatgagggctgctacatgtgtctcttcaacacgtttggttctcagaaggtctcaggaacagcttgccttaccctctatgtacagcccatagtacaccttcactacaactattttgaagaccacctaaacatcacttgctctgcgactgcccgtccagcccctgccatctcctggaagggtactgggacaggaattgagaatagtaccgagagtcacttccattcaaatgggactacatctgtcaccagcatcctccgggtcaaagaccccaaaactcaagttgggaaggaagtgatctgccaggttttatacctggggaatgtgattgactacaagcagagtctggacaaaggattttggttttcagttccactgttgctaagcattgtttctctggtaattcttctgatcttgatctccatcttactatactggaaacgtcaccgaaatcaggagcggggtgaatcatcacaggggatgcaaagaatgaaataagagctctaaagaaattatacagaaccctgaacgtgtttccctggtctacttgaatctgatgtgaaagaaaagcaggagggaaaaggccattctccataggacctaaggagagcaaaagaccagacacgagcctgtgagggatttgactttttgctgttgtcccaggtcctcggtgtttgcattccaagaggaagtcgagtgcctcgggtctgttgtaggacttgattttttttttttttgtagagcaatgcagtgccatgctgttagaaaggctccagacttagaaccaccagtgccaagccagctctcagaccgactagggctcccatcggaggaacaaatcgtagtcaacttacctcacagagctctctggtccttacacaaagtagaaaggagtgggaccagaaaattggccatgtctgaaatctgatggaatttttaggaagaaaactgaagaataagcaaaagaagaaagaacacagaagggtccaaagagcttctgagagtaccttttgcctttctgttggtgtcccagctctggttttgttcttaggtccgccagtgtgtttccctgttgtttgagtatctagttgactacctgctactgttctgctgatggttggccttgctagaatccctgactcccctgccgttctctatgtgcttctatgagggttactatgatgaaaatagagcagaagatagtgtgaagtaacattggcaactgtaatgtgtccatttaacttatttttatagcacttaggcaatattgttagtcttagtgagtagttcacatctttacaaaagcatgctctccctatccattgggcccacaataacactctctttgaggccattctgaatcctgtctcgtgtaatgataatatattatgaaaacagatactttaagaatttcctgtacagcagtcagttgtttattctctctctctctctctctctctctctccctcccccaccccagcttctttttctgtgactttgtttttcataaagagaaggcatctcctgaatacaatcgctttgttctgaagacatcgtgaactattaattcttaaccctttgacaaaactagtgaagttgttttctgtatcttttgcttcatctgtctttatagagtgacctaggaattcaagtgtaagttgtttccattgttgaactggatatttatatacttggtatgcttttcacgtgttatttaattctgtataatttcctatatttgtattaaaatattgagcaattaaaagtgtcaactaaatatttgatgtggcattcccttgagaaatatagaaataaagaataaaaaaaaaaaaaaaaaa

SEQ ID NO: 28 - protein, 278 aa, Mus musculus
MGSLVFRRPFCHLSTYSLIWGMAAVALSTAQVEVVTQDERKALHTTASLRCSLKTSQEPLIVTWQKKKAVSPENMVTYSKTHGVVIQPAYKDRINVTELGLWNSSITFWNTTLEDEGCYMCLFNTFGSQKVSGTACLTLYVQPIVHLHYNYFEDHLNITCSATARPAPAISWKGTGTGIENSTESHFHSNGTTSVTSILRVKDPKTQVGKEVICQVLYLGNVIDYKQSLDKGFWFSVPLLLSIVSLVILLILISILLYWKRHRNQERGESSQGMQRMK

SEQ ID NO: 29 - DNA, 1724 bp, Homo sapiens
ctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 30 - protein, 355 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 31 - DNA, 1586 bp, Mus musculus
gccaaatagctgtggtttctgtttcctagctcagccctgccctgcgcagagttctgtcgtccaccatcgagtgaggaagagagcattggttcccctgagatagaagagatggctctcttcagtgcccagtctccatacattaacccgatcatcccctttactggaccaatccaaggagggctgcaggagggacttcaggtgaccctccaggggactaccaagagttttgcacaaaggtttgtggtgaactttcagaacagcttcaatggaaatgacattgccttccacttcaacccccggtttgaggaaggagggtatgtggtttgcaacacgaagcagaacggacagtggggtcctgaggagagaaagatgcagatgcccttccagaaggggatgccctttgagctttgcttcctggtgcagaggtcagagttcaaggtgatggtgaacaagaaattctttgtgcagtaccaacaccgcgtaccctaccacctcgtggacaccatcgctgtctccggctgcttgaagctgtcctttatcaccttccagaactctgcagcccctgtccagcatgtcttctccacagtgcagttctctcagccagtccagttcccacggacccctaaggggcgcaaacagaaaactcagaactttcgtcctgcccaccaggcacccatggctcaaactaccatccatatggttcacagcacccctggacagatgttctctactcctggaatccctcctgtggtgtaccccaccccagcctataccatacctttctacacccccattccaaatgggctttacccgtccaagtccatcatgatatcaggcaatgtcttgccagatgctacgaggttccatatcaaccttcgctgtggaggtgacattgctttccacctgaacccccgtttcaatgagaatgctgttgtccgaaacactcagatcaacaactcctgggggcaggaagagcgaagtctgcttgggaggatgcccttcagtcgaggccagagcttctcggtgtggatcatatgtgaaggtcactgcttcaaggtagctgtgaatggtcaacacatgtgtgaatattaccaccgcctgaagaacttgcaggatatcaacactctagaagtggcgggtgatatccagctgacccacgtgcagacataggcaaggtctctggcctagggataagggctggagcactctgcctgtgtcttatctttcccctgtctcagccctggcaccatcagaagagatcatcacttataggaattccaggaaggtgaaattcccaattgactccctccacaaagggggttttctaggctgtgtggcacatggctgtcagcccatagtctgagccattgcccccaagctagctatatactgagggaagtgaccctcctgggtttgctcagatctctgatcgttcccccctctgtggcccttttctttcacccctccaggagagccaccctgatatcatcccactggcctccaactgacccacaatgtccacagtaactttcccccattctcacccagtatccataaaataaagaaataatattgcttgtctacac

SEQ ID NO: 32 - protein, 353 aa, Mus musculus
MALFSAQSPYINPIIPFTGPIQGGLQEGLQVTLQGTTKSFAQRFVVNFQNSFNGNDIAFHFNPRFEEGGYVVCNTKQNGQWGPEERKMQMPFQKGMPFELCFLVQRSEFKVMVNKKFFVQYQHRVPYHLVDTIAVSGCLKLSFITFQNSAAPVQHVFSTVQFSQPVQFPRTPKGRKQKTQNFRPAHQAPMAQTTIHMVHSTPGQMFSTPGIPPVVYPTPAYTIPFYTPIPNGLYPSKSIMISGNVLPDATRFHINLRCGGDIAFHLNPRFNENAVVRNTQINNSWGQEERSLLGRMPFSRGQSFSVWIICEGHCFKVAVNGQHMCEYYHRLKNLQDINTLEVAGDIQLTHVQT

SEQ ID NO: 33 - DNA, 5792 bp, Homo sapiens
agtcacttgtctggagcttgaagaagtgggtattccccttcccaccccaggcactggaggagcggccccccggggattccaggacctgagctccgggagctggactcgcagcgaccgcggcagagcgagcgggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactccaagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctccagcggctgtgtgcaatggggtcttttgtggaaatcaaggagcagacaggtttcatgtgtactgtcaccacgtgggatggaaccagaggcatggaagcaagacgctaaatgaagagggccataagggctgggattcccaggcaccttaggaacagcttgtctttttttttttcctctccaaaaaaaatgtttaagggacggtgtctcctgtcacccaggctggagtgcaatggcacgatcatagctcattgcagcctctaactccggggctcaagcaatcctcccacctcagcctaccaagtagctgtgaccacagctgcccctcaccatgctaagctaatttttttaattagatagtacataaacgtcccaaaattagaagataaaaagacatgagggatccattctaatttgtgtttggagtgtaatggtccagctccattcttctgcacatggatatccagttttacacaacactgtgaatgtaatgaatgccactgaatcatacactcaaaaatagctaaaatggcaaattgtctgttatctctttttaaccaccatttttgaaaattaattataccaaaaaaccattgaatagtgcactttatttatttatttatttgtttatttatttatttattttagaaataagagtctcactttgttgcccaggctggagtgcagtggcgtgatcatggctcattgcagcctcgacctgctgggctcgggctatccttccatctcagcctcccgagtagctgggactataggtgggcgccaccccacctggctaaatctctttttaacttttgtagagataggcatctcgctatgttgcctaggctgggctggaactcctgggctcaagtgctcctcctgccttggcctcccaaagcgctaggattacagatgtgagccaccgcgcccaccctgaaccttactttttttgctcagtttctggtaattcagagaatgcctcctgagttgttctacacccacctcatattccatgggagggctgtacagggcttttttaacgaggcctctaaggacaggcatttgtatcctttccagcctttcactattacaatgttgtagtgaataactttacacactgtcatttattttacttttttttttttttattttagagaaaggaatcttgccatcttgcccaggctggtctcaaattcctgggcccaaacaatcctcccgccttggcctcctaaagtactgggatttataggcataagccaccgtgcctggccaatgcacactgtcatttagctcatgttaacacctgagtgtaggacacactcctggaggtggaattgctgggccaaagagtatgtttcttgtcattgtgatagatattgacaaatgaaccctcacagaagttgtgctgagttctgttcccaccagcgacgtaggcgatgacctttttctggagggagggggcatccttggagtccacagagccaggaatggagagtgggcccagaattttggtataggtgttgtataaacttatagtaaggttaagaaaaccgcaactatccttatcagagacttggcggggggcagggtatgatggagatcataaggaggctaaaacactccacaccctccctctgcattgctcctgcacgggagtcgggaatcttttcaggttgatacgatctcaccttgaggagctgtgaggtcccagaagcctctgggttgcagattgcttggggtgaaaatgtctgtgctactgaaatctaactttttacaaaaaattacgggctgggcgcagtggctcacgcctgtaatcccagcactttgggaggctgcagcgggtggatcacttgaggtaaggagttcaagaccagaccatagtgaaaccgtgtctctacaaaaaaaattagccaggtgtggtggtgcatgcttgtaatcccagctactcagaaggctgaggtgggagaatcccttgaacccgggaagtggaggctggagtaaaccatgatcgagttactgcactccagcctgggtgacaagagtgagactctgtctccaaaaaaaaaaaaaaaaaaaaaaaaactggattgcctggctctactccgggcacagcatgcaggcccagttctgctgctctgctgtttgttctgctttcctccacatattggcatcaccctctggtgccaagatggctgctgcattccaggcatcacatccagactcagacccagagaagctgcccatccctacctgggtgagcctttgtaggaacgagaaaccgcatccagcagcagaaacctcacccagcagcgtcttttccggtctcattcaccagcgccgcccaccgctcaaccaatccctggccaaaagaatgggaccgcctggaaggctggaccaaacaggacctgccctctggggctggggagaggcccagatgaaggctgcaggacaggatggactcctagacctctgttaccagcagtgactacctctgtctgggtggttggaacatgtttgaattttattctaagtactgtctacaagttctgcaataaaccttgactcttcttttaataatgcaaaa

SEQ ID NO: 34 - protein, 417 aa, Homo sapiens
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGMSRNAIIFLVLGILVFLILLGIGIYFYWSKCSREVLWHCHLCPSSTEHASASANGHVSYSAVSRENSSSQDPQTEGTR

SEQ ID NO: 35 - DNA, 2902 bp, Mus musculus
aggcggcacccgcttagctgagattccagcacttgacttcagggtttcggagagataaggcgcttggccgttactaactggactacaaagagctggatcggaccggaaccacatggctcaactcgcccgagccacccgctccccgctgtcatggctgctgctgctgttctgctatgcactccggaaagcgggtggggatatacgtgtgctggtgccctacaattcgacaggcgtcttgggagggtcgaccaccttgcactgtagtctgacttctaatgagaatgtgactatcactcaaataacctggatgaagaaggattcaggtggatcccacgctcttgtggctgtcttccaccccaagaaggggcccaacatcaaagagccagagagggtgaaattcttggctgcccaacaggatctgaggaacgcatctctggccatctcgaacttaagtgtagaagacgaaggcatctatgaatgtcagattgccacattccccagaggcagtagaagcaccaatgcctggctgaaggtgcaagcccgacctaagaacactgcagaggccctggagccctctcccaccttgatactgcaggatgtggctaaatgcatctctgccaatggtcaccctcctggacgaatctcttggccctcgaatgtgaatggaagtcaccgtgaaatgaaggaaccagggtcccagccgggcaccaccacagttaccagctacctctccatggtaccttctcgccaggcagacggcaagaacatcacctgcacggtggagcatgaaagcttacaggagctggaccagctgctggtgaccctttcccaaccctatccacctgaaaacgtgtccatctctggctatgacggcaactggtatgttggcctcactaacttgaccctgacctgtgaagctcacagcaaaccagcgcctgacatggctggatataactggagcacgaacacgggtgactttcccaactctgttaagcgccagggcaatatgcttctaatctccaccgtagaggatggtctcaataacacggtcattgtgtgcgaagtcaccaatgccctagggtctgggcagggccaagtgcacatcattgttaaagagaaacctgagaatatgcagcaaaatacaagattacacctaggctacatctttcttatcgtctttgtcctcgctgtagtcatcatcatcgcagcactatacactatacgaagatgcaggcatggtcgtgctctgcagtccaatccctcagagagggagaacgtccagtattcatctgtgaacggcgactgtagactgaacatggagccaaacagcacaaggtgacggtgctgggtagacagaactaaggaacttgaaggcatagcaactggaaccctactctcataaatgaagaagcctccagagagactggctgctcagtgtgatgagcatagcaagtttggggggtctcccaggatgctgccgaattccacgttgtcaaaaggacccatggaggccagtgtgttggctcactcttgacatctcagcaagctgggggggggggggggagcataaagcaaggttgagtctagcttgggctatagagcaaagccctgtccatacacaaacaagctaaggggctttgagacggtcagaaactgaagtcttgctttgggtaaggtaaatcctctaccgcatgtatgtgctagacttgaaagacttccacacagacctctttataagttgactccattggggctatcccctcctctctggacaaggtctctgtatgtagccaaggctaggctcaaactcacagagatatgtctgcttctacctccccagtgctagagttgaaagtatttgtgccactgcacttttctaggtcttcttttaatgaagtaaagtatatatttataaaaagctatttagttatatatatatatatttttgagactatttcatagagcccaagctaacctcaaacttactatgtagccaagagtgatggtaaactaatttattttaatttatttgtcttcaattttaaccatcacccaacccctgctcccttccatatcttctttcaatccatttcattgtctttttcttcccagacactattctgacttacgtctccattacaaacattttattgaactacataaaaatgtgtgaaccacaaaaaaaaaatgtatttgtcaaaattgtagttgtctttctgaggctgacctgagttctctgataccattctctccagttgtatccagtttcctgtaaacaatgtgactttgtttttctcagtagctaaaacatcccaattatgtgagtgtacactttctttactcattcctctgtgggccaccagctgggttggttccatatctgagctattgtgcatggaattgtctctgtggtgggtttagtaaactcccaggaatgcctgtacatgtttgtagaggccagaagaaggcacaaaatcttgagccaggcttacatgcacttgtgagtagccccacataggtgctaagaacccagttcaggtcctctgctgtgggatggtgggctgtgcacagaaagcctggtcccggtctagcaaaggtctggaactccggagccggtgggctgtgatttacaccagcatgggatggaaggagttggacctcgcctcctgggcacctggctcctgtcacatagctacagcctcccacagcccccctatagggaggtatgcagcatcaatcacatagtagctgcactaagccctcccacatgcaaataaggtttccccaaactctcagtccaagccaatgaaaagtacctgctgtcaaaccctaaatcatccccaaaactctgtaagtcctatcagggaataaaatgtgtgtgaaaactaaaaaaaaaaaaaaa

SEQ ID NO: 36 - protein, 408 aa, Mus musculus
MAQLARATRSPLSWLLLLFCYALRKAGGDIRVLVPYNSTGVLGGSTTLHCSLTSNENVTITQITWMKKDSGGSHALVAVFHPKKGPNIKEPERVKFLAAQQDLRNASLAISNLSVEDEGIYECQIATFPRGSRSTNAWLKVQARPKNTAEALEPSPTLILQDVAKCISANGHPPGRISWPSNVNGSHREMKEPGSQPGTTTVTSYLSMVPSRQADGKNITCTVEHESLQELDQLLVTLSQPYPPENVSISGYDGNWYVGLTNLTLTCEAHSKPAPDMAGYNWSTNTGDFPNSVKRQGNMLLISTVEDGLNNTVIVCEVTNALGSGQGQVHIIVKEKPENMQQNTRLHLGYIFLIVFVLAVVIIIAALYTIRRCRHGRALQSNPSERENVQYSSVNGDCRLNMEPNSTR

SEQ ID NO: 37 - DNA, 1987 bp, Homo sapiens
gtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaaca

SEQ ID NO: 38 - protein, 479 aa, Homo sapiens
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPRASPRDVGPLVWGAVGGTLLVLLLLAGGSLAFILLRVRRRRKSPGGAGGGASGDGGFYDPKAQVLGNGDPVFWTPVVPGPMEPDGKDEEEEEEEEKAEKGLMLPPPPALEDDMESQLDGSLISRRAVYV

SEQ ID NO: 39 - DNA, 2009 bp, Mus musculus
gagccctaggatcggcttggcgaagaggggcggggcctgtgacgtcatgagtccggcccgctggagctaagcgaggggccggggggcgcggatcctgagagccaggcgagggaaagctgggccgaacgaactgatccggggagccgtgagcggcggaagccggcctggagccggacacttcagacccctgactgccctcccagccgatcggtacacgaagagtggtccctaggcaccccctgcccgggcccagtccctccccgggccccccatggcccgggccgcagtcctcccgccgtccagattgtcaccgacgctgccgttgttgccgctgctactgctcctgcttcaggaaacaggagcccaagatgtgcgggtacgagtgcttcccgaggtccggggccgcttgggaggcaccgtggagttaccgtgccacctgctcccacccacgacggagcgcgtctctcaggtgacctggcagcgcctggatggcacagttgtggctgctttccacccatccttcggagtggatttccccaactctcagttcagcaaggaccgtctgtcctttgtcagagcgagaccagaaacaaacgcagacctgcgggatgccacactggccttccggggactgagggtagaggacgagggcaattacacctgcgagtttgccacgtttcccaacggtacccgcaggggggtgacctggctcagagtcatagcccagcctgagaaccacgctgaagcccaggaggtcacaattggcccccagtcggtggctgtagcccgctgtgtctccactgggggccgcccccctgcccgaatcacctggatctcatctctgggtggagaggccaaagatactcaggagccagggatacaggctggcaccgtcactatcatcagccgatactccttggtgcccgtgggccgagcggatggcgtcaaggtcacgtgtagagtggaacacgagagcttcgaagagccgatcctgctgccagtgaccctctctgtgcgctaccctccagaagtatccatctccggctatgatgacaactggtaccttggccgcagtgaggccatactgacctgtgatgtacgaagcaacccagagcccacagactatgactggagcacgacctcgggcgtcttcccagcctctgcagtggcccagggctctcagctgcttgtccactctgtggatcgaatggtcaacactaccttcatctgtacagccaccaacgctgtggggacaggccgtgctgagcaggtcatcctggtgcgagacaccccccaggcctcccgagatgtgggtccgctggtgtggggggccgtggggggaacattgctggtgctactcctggctggggggttcctggccttgatcctgctgagggggaggaggaggcggaagagccctggaggaggaggaaatgatggcgacagaggatcctacgatccaaagactcaggtgtttgggaacgggggtcctgtcttctggaggtcagcatcccctgagcccatgaggccagatggcagggaggaagatgaggaggaggaggaagaaatgaaggcagaggaaggtctcatgctacctccacacgagtcacctaaggacgacatggagtcccatctggatggctccctcatctctcggcgggcagtttacgtgtgaccctacgatatagacactggacacatggaaacaccaagttccaccctcactgccaaccacaccaatgccagccagcaacgatggctagggaccggttggactggttcttctggggcacactggagttggaagggcaccgcccctgctttcaggatagaggacaagtggaaccacacagactcctatctttagggcctcatggagtaggggaccccaggagcgccatggtgcacactcaggactcctcagagcttgctttcggccccagcctagccctggccccgaaacactcaggagctaataaatgccttgtcggaaaaaaaaaaaaaaaaaa

SEQ ID NO: 40 - protein, 467 aa, Mus musculus
MARAAVLPPSRLSPTLPLLPLLLLLLQETGAQDVRVRVLPEVRGRLGGTVELPCHLLPPTTERVSQVTWQRLDGTVVAAFHPSFGVDFPNSQFSKDRLSFVRARPETNADLRDATLAFRGLRVEDEGNYTCEFATFPNGTRRGVTWLRVIAQPENHAEAQEVTIGPQSVAVARCVSTGGRPPARITWISSLGGEAKDTQEPGIQAGTVTIISRYSLVPVGRADGVKVTCRVEHESFEEPILLPVTLSVRYPPEVSISGYDDNWYLGRSEAILTCDVRSNPEPTDYDWSTTSGVFPASAVAQGSQLLVHSVDRMVNTTFICTATNAVGTGRAEQVILVRDTPQASRDVGPLVWGAVGGTLLVLLLAGGFLALILLRGRRRRKSPGGGGNDGDRGSYDPKTQVFGNGGPVFWRSASPEPMRPDGREEDEEEEEEMKAEEGLMLPPHESPKDDMESHLDGSLISRRAVYV

SEQ ID NO: 41 - DNA, 2690 bp, Homo sapiens
gtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccgaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatctgaattgggggtagcaattgatactgttttgtaaactacatttcctacaaaatatgaatttatactttga

SEQ ID NO: 42 - protein, 538 aa, Homo sapiens
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 43 - DNA, 2735 bp, Mus musculus
gagccctaggatcggcttggcgaagaggggcggggcctgtgacgtcatgagtccggcccgctggagctaagcgaggggccggggggcgcggatcctgagagccaggcgagggaaagctgggccgaacgaactgatccggggagccgtgagcggcggaagccggcctggagccggacacttcagacccctgactgccctcccagccgatcggtacacgaagagtggtccctaggcaccccctgcccgggcccagtccctccccgggccccccatggcccgggccgcagtcctcccgccgtccagattgtcaccgacgctgccgttgttgccgctgctactgctcctgcttcaggaaacaggagcccaagatgtgcgggtacgagtgcttcccgaggtccggggccgcttgggaggcaccgtggagttaccgtgccacctgctcccacccacgacggagcgcgtctctcaggtgacctggcagcgcctggatggcacagttgtggctgctttccacccatccttcggagtggatttccccaactctcagttcagcaaggaccgtctgtcctttgtcagagcgagaccagaaacaaacgcagacctgcgggatgccacactggccttccggggactgagggtagaggacgagggcaattacacctgcgagtttgccacgtttcccaacggtacccgcaggggggtgacctggctcagagtcatagcccagcctgagaaccacgctgaagcccaggaggtcacaattggcccccagtcggtggctgtagcccgctgtgtctccactgggggccgcccccctgcccgaatcacctggatctcatctctgggtggagaggccaaagatactcaggagccagggatacaggctggcaccgtcactatcatcagccgatactccttggtgcccgtgggccgagcggatggcgtcaaggtcacgtgtagagtggaacacgagagcttcgaagagccgatcctgctgccagtgaccctctctgtgcgctaccctccagaagtatccatctccggctatgatgacaactggtaccttggccgcagtgaggccatactgacctgtgatgtacgaagcaacccagagcccacagactatgactggagcacgacctcgggcgtcttcccagcctctgcagtggcccagggctctcagctgcttgtccactctgtggatcgaatggtcaacactaccttcatctgtacagccaccaacgctgtggggacaggccgtgctgagcaggtcatcctggtgcgagagtcacccagcacagcaggagcaggggccactggtggcatcattggaggtattatcgctgccatcatcgccaccgcagtggctggcacaggcatcctcatctgccgacaacagcggaaggagcagaggcttcaagctgcggatgaggaagaagaactggaaggacctccctcctataaaccacccaccccgaaggccaagctggaggaaccagagatgccctctcaactcttcaccttgggggcctcagagcacagcccagtgaagacgccatactttgatgctggtgtctcttgtgctgatcaggagatgcctcggtatcacgagctgcccactctggaagagcggtcagggcccctgctgttgggggctacaggcctgggaccttctcttctggtgcctccaggacccaatgttgtggagggggtttccctgagtctcgaagatgaggaggaagatgatgaggaggaagacttcctggataaaatcaaccctatttatgatgccctgtcctaccccagcccctctgactcctaccagagcaaagacttttttgtgtcacgggccatgtatgtgtgagggaggcacaggggctctgacgtctcacctttcacccttgacccatgagctttccaccagtaatctaggacactctgacttccaggcagaccagggacaactatcacccattgcaatccacctgtgacttcttagtgactccaccatgacgtccaatctatgatgtctgaggcaggcaaacctgcacaactggaaacctggagatttttatctcccttggcagggagctcaccatatccttctgcaccacctgtgaccccccccccccccccaaggactcctaagactacgaccctttgaccatgccactcagtatctcaagaacccttaaagtcccaaaggaatcggaccttgcacttgtcctcaggcaatagagtccaacagatatgcaagaacgggatcaggggctccctgttgctcagacctgagccctccaggcagcagaagctcacctgatccctccccaccctgctccccaaaggtgaaaaggagaggattccccaatgtaaggtaggacctccccatctccacctactcctgcaggcaggaatctcaggtttctcacaccctctcctcagcacccaggttcctgtctccagagcatgaattccaggtccaatgctagaggggagaacctaatgcaagtgtgccttgccaccccaagtttgggagactctgctcttatcctgaggactactgaattcttttaacccctacccagtgagatgagaactacatatccctctttaggggatggtgtgtgtatgtgtgtgtgatggagaatctgggcatctgggttgggaattttattttgtaagcatttcctacataatatgagtttctactttgataaagtcttgtgttttctgtg

SEQ ID NO: 44 - protein, 530 aa, Mus musculus
MARAAVLPPSRLSPTLPLLPLLLLLLQETGAQDVRVRVLPEVRGRLGGTVELPCHLLPPTTERVSQVTWQRLDGTVVAAFHPSFGVDFPNSQFSKDRLSFVRARPETNADLRDATLAFRGLRVEDEGNYTCEFATFPNGTRRGVTWLRVIAQPENHAEAQEVTIGPQSVAVARCVSTGGRPPARITWISSLGGEAKDTQEPGIQAGTVTIISRYSLVPVGRADGVKVTCRVEHESFEEPILLPVTLSVRYPPEVSISGYDDNWYLGRSEAILTCDVRSNPEPTDYDWSTTSGVFPASAVAQGSQLLVHSVDRMVNTTFICTATNAVGTGRAEQVILVRESPSTAGAGATGGIIGGIIAAIIATAVAGTGILICRQQRKEQRLQAADEEEELEGPPSYKPPTPKAKLEEPEMPSQLFTLGASEHSPVKTPYFDAGVSCADQEMPRYHELPTLEERSGPLLLGATGLGPSLLVPPGPNVVEGVSLSLEDEEEDDEEEDFLDKINPIYDALSYPSPSDSYQSKDFFVSRAMYV

SEQ ID NO: 45 - DNA, 1630 bp, Homo sapiens
acacatcaggggcttgctcttgcaaaaccaaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctcttatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaataaaaataaaaataaatttggttctaatagaactcagttttaactagaatttattcaattcctctgggaatgttacattgtttgtctgtcttcatagcagattttaattttgaataaataaatgtatcttattcacatca

SEQ ID NO: 46 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 47 - DNA, 1306 bp, Mus musculus
acatttagagacttgctcttgcactaccaaagccacaaggcagccttgcagaaaagagagctccatcatgcctggctcagcactgctatgctgcctgctcttactgactggcatgaggatcagcaggggccagtacagccgggaagacaataactgcacccacttcccagtcggccagagccacatgctcctagagctgcggactgccttcagccaggtgaagactttctttcaaacaaaggaccagctggacaacatactgctaaccgactccttaatgcaggactttaagggttacttgggttgccaagccttatcggaaatgatccagttttacctggtagaagtgatgccccaggcagagaagcatggcccagaaatcaaggagcatttgaattccctgggtgagaagctgaagaccctcaggatgcggctgaggcgctgtcatcgatttctcccctgtgaaaataagagcaaggcagtggagcaggtgaagagtgattttaataagctccaagaccaaggtgtctacaaggccatgaatgaatttgacatcttcatcaactgcatagaagcatacatgatgatcaaaatgaaaagctaaaacacctgcagtgtgtattgagtctgctggactccaggacctagacagagctctctaaatctgatccagggatcttagctaacggaaacaactccttggaaaacctcgtttgtacctctctccgaaatatttattacctctgatacctcagttcccattctatttattcactgagcttctctgtgaactatttagaaagaagcccaatattataattttacagtatttattatttttaacctgtgtttaagctgtttccattggggacactttatagtatttaaagggagattatattatatgatgggaggggttcttccttgggaagcaattgaagcttctattctaaggctggccacacttgagagctgcagggccctttgctatggtgtcctttcaattgctctcatccctgagttcagagctcctaagagagttgtgaagaaactcatgggtcttgggaagagaaaccagggagatcctttgatgatcattcctgcagcagctcagagggttcccctactgtcatcccccagccgcttcatccctgaaaactgtggccagtttgttatttataaccacctaaaattagttctaatagaactcatttttaactagaagtaatgcaattcctctgggaatggtgtattgtttgtctgcctttgtagcagactctaattttgaataaatggatcttattcg

SEQ ID NO: 48 - protein, 178 aa, Mus musculus
MPGSALLCCLLLLTGMRISRGQYSREDNNCTHFPVGQSHMLLELRTAFSQVKTFFQTKDQLDNILLTDSLMQDFKGYLGCQALSEMIQFYLVEVMPQAEKHGPEIKEHLNSLGEKLKTLRMRLRRCHRFLPCENKSKAVEQVKSDFNKLQDQGVYKAMNEFDIFINCIEAYMMIKMKS

SEQ ID NO: 49 - DNA, 1439 bp, Homo sapiens
agtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaaaggatgatcaaaacacacagtgtttatgttggaatcttttggaactcctttgatctcactgttattattaacatttatttattatttttctaaatgtgaaagcaatacataatttagggaaaattggaaaatataggaaactttaaacgagaaaatgaaacctctcataatcccactgcatagaaataacaagcgttaacattttcatatttttttctttcagtcatttttctatttgtggtatatgtatatatgtacctatatgtatttgcatttgaaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttgaacacacaaaaaaaaaaaaaaaa

SEQ ID NO: 50 - protein, 277 aa, Homo sapiens
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 51 - DNA, 1601 bp, Mus musculus
ccgctgctctgagaatttcgtgtgggcagccccgacattgtaaccggctctgcaaccgaagagatggtcgtcctcctttgcttatgcgtcttgctgtgggaagaggctcacggatggggattcaagaacgggatctttcataactccatatggcttgaacaagcagcgggcgtataccacagagaagctcgggctggcagatacaagctcacctacgccgaagccaaggccgtatgtgaatttgaaggtggtcgtctcgcaacctacaagcagctagaggcagccagaaaaattggattccatgtctgtgctgctggatggatggccaagggtagagtcggataccccattgtgaaacctgggcccaactgtggatttgggaaaacgggtatcatcgattatggaatccggctcaacaggagtgagcgatgggatgcctattgctacaacccacatgcaaaggagtgtggtggtgtcttcacagatccgaagcgaatttttaaatccccgggcttcccaaatgagtacgatgacaaccaggtctgctactggcacattcggctcaagtacggtcagcgaattcacctgagctttttggactttgaccttgaacatgatccaggctgcttggctgactatgtagaaatctatgacagttatgatgacgtccacggctttgtaggaagatactgtggtgatgaacttccagaagacatcattagcacaggaaatgtcatgaccttgaagtttctgagtgatgcatccgtcacggctggaggcttccagattaaatacgtcacagtggatcctgcatctaaatccagtcaagccaaaaatacaagtactactggaaataagaagttcttacctggaaggtttagccatctataaaaaattttttttaaaaatgttcaaaacatccagtacaatatttatatttgtttttgttgttgttgttggtttttttttttttattttgttttgttttgtttttttgagacggggtttctctgtatagccttggctgtcctggaactcactttgaagaccaggctggcctcgaactcagaaatccacctgcctccgcctaccaagtgctgggattaaaggcgtccaccaccaccgcccggcttcaatatttatatttgtagctcttggacctcgtttgttctcttttgtatttttattattaacatgtatttattatttttccaaatgtgaaagccatatgtaattatgtggaaaattgacaaataaatacagagaacttcaaatgagttttttttttaaatctcataattgtactacacagaaataactaatgttaaagtttttaaatgtttgtctttcattcatttttctacttgtagtatatgtacatatgtaactctatgatttgcgtttgaattttggcattctgccttttgtaacctgatatttttaaccttgacattgtatagctcaagcacttcccaagatctctgagttttctacaaaatgggactttgtaaatatgattgttccctgctttatttaagctgaatttatattaggatttaaggttgttttcataaatattgctgtaataaatacttttggat

SEQ ID NO: 52 - protein, 275 aa, Mus musculus
MVVLLCLCVLLWEEAHGWGFKNGIFHNSIWLEQAAGVYHREARAGRYKLTYAEAKAVCEFEGGRLATYKQLEAARKIGFHVCAAGWMAKGRVGYPIVKPGPNCGFGKTGIIDYGIRLNRSERWDAYCYNPHAKECGGVFTDPKRIFKSPGFPNEYDDNQVCYWHIRLKYGQRIHLSFLDFDLEHDPGCLADYVEIYDSYDDVHGFVGRYCGDELPEDIISTGNVMTLKFLSDASVTAGGFQIKYVTVDPASKSSQAKNTSTTGNKKFLPGRFSHL

SEQ ID NO: 53 - DNA, 3295 bp, Homo sapiens
attcgggccgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaa

SEQ ID NO: 54 - protein, 534 aa, Homo sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 55 - DNA, 3197 bp, Mus musculus
cggcgcggcgcgccaaagtgacctggtacagcctggaccccaagctcatcggctttgtctggctggccgcctggcctcttcccacttggatttggatgatcctgaggcctttggaggaacttcgagacaaaggcccctcttcctcttccacgggcaggagcagccattcgccacggagagcccagctgtcagctgtctcacaggaagatgcttcgaggatggggtggccccagtgtgggtgtgtgtgtgcgcacagcactgggggtgctgtgcctctgcctcacaggagctgtggaagtccaggtctctgaagaccccgtggtggccctggtggacacggatgccaccctacgctgctccttttccccagagcctggcttcagtctggcacagctcaacctcatctggcagctgacagacaccaaacagctggtgcacagcttcacggagggccgggaccaaggcagtgcctactccaaccgcacagcgctcttccctgacctgttggtgcaaggcaatgcgtccttgaggctgcagcgcgtccgagtaaccgacgagggcagctacacctgctttgtgagcatccaggactttgacagcgctgctgttagcctgcaggtggccgccccctactcgaagcccagcatgaccctggagcccaacaaggacctacgtccagggaacatggtgaccatcacgtgctctagctaccagggctatccggaggccgaggtgttctggaaggatggacagggagtgcccttgactggcaatgtgaccacatcccagatggccaacgagcggggcttgttcgatgttcacagcgtgctgagggtggtgctgggtgctaacggcacctacagctgcctggtacgcaacccggtgttgcagcaagatgctcacggctcagtcaccatcacagggcagcccctgacattcccccctgaggctctgtgggtaaccgtggggctctctgtctgtcttgtggtactactggtggccctggctttcgtgtgctggagaaagatcaagcagagctgcgaggaggagaatgcaggtgccgaggaccaggatggagatggagaaggatccaagacagctctacggcctctgaaaccctctgaaaacaaagaagatgacggacaagaaattgcttgattgggagctgctgcccttcccaggtggggggcccaccctctggcagtgttgagcttcaatgcgagcccttcccccaacgaatgggtttgtcccacagatctacccgttcgtcaaaggacgtggtccatagaccacccacagccttacttttccaatggacttaattcccatcatcctgcagcctcatttctccagtgacacgatacacgaaccatcctgcggccttatttcccacggacacgacacaaagatgtccctcctcggtgttcctccagagtcgtctggtggccttgtgatacggcgtgaaccttcttccttctgccttacgtctaatggacacacacgcaccacccccacacccttgctcctccaaagccatgcagactgtgtaactgctattattctccaaggggcatcctgtgcagatgaaaccctgctttatttccctgaagacagctgcacagtgacctcttagttcttgctcccatggccctgatgtatcctagttaccagccctcaacctcagttctgagggtgggatcccatcgctcagcaaggcttcatcctgacctccctgccctgatctgatctggccctggcttttgttgtctcgctccctgactaagtgagatggggcactctcccgcccccgccccccccaggtcacagatacctacctgcagctgtgcgtgctggatcacgcacatacttgccttgcatggtctcctggctgccctgggctgtgcctgttcttccataggaagcaagttcttgtctccctggttctcagggcccctcaggggctcagccttcagccctgtgcttccccatgttgggaatctttgttacctttttcttctttgtaaattaacatctgataacaaccacagggtccaatgggactttcacagacctgccagctagataaataatgacaacagaagtttattaatattttaagacttaggccttttgctgggcagcctcccaactattctatcctgactaatcctggcactatgtcccaccacatggccaggtctacctctctgctccactctccatccacctccatgtctgccagcaaatctcccgtgattcagttcttctcccagagtccctatctctgcccagaagtaccatcttcgacttcctgcccaactattggccgtcagctcttcattaaagccgatcagatgtaattctagattgccttaggcaggtgaggaagaaacaagtatttgtaaaatatgagaccagcaatgggccatagaaataacagcaccagatcctgccagcatttagccctctgttggtacaaaattaacaattgaatatacagagacctacttccagagtgtaccccaacaacaggcgtgagcatggtgctgggtactagggtcctgctggaaaatcagagaccttacctacagctgggacatgaccttgcttccgacttacccaccacttctggatacctcaccctcagcccacactatccctggcctagggcccagggtagagccagaaacatggagaaagcatggccccttgccgtacctggagaactgggtattttccagagtctttatagatgtggactggaaggcaggtggccacagccgtgcagacctgggtcaggtcagaaacctatgccatgctgggacctactcaacagcagaagcatgaagagggcctgaggacaagaaaggccttcttaccatggtgctattctggagctgggatatatacctggcttgtctctgactgccctggcttctggcagaacttctgatgtcctcctgaaggcctctctcccaccccagtacctgagaacctgaggataatttaaacatgggactctggccagcacctgggagagacaggtagatctctgatttttgactcagcctggtctatcgagtgagttccaggacatctggggctacacagagaaaccatcttaaagactaaaaataataaacatgagactgtaaactgggtgtattttgggagaaataaatgtctttttctttcaa

SEQ ID NO: 56 - protein, 316 aa, Mus musculus
MLRGWGGPSVGVCVRTALGVLCLCLTGAVEVQVSEDPVVALVDTDATLRCSFSPEPGFSLAQLNLIWQLTDTKQLVHSFTEGRDQGSAYSNRTALFPDLLVQGNASLRLQRVRVTDEGSYTCFVSIQDFDSAAVSLQVAAPYSKPSMTLEPNKDLRPGNMVTITCSSYQGYPEAEVFWKDGQGVPLTGNVTTSQMANERGLFDVHSVLRVVLGANGTYSCLVRNPVLQQDAHGSVTITGQPLTFPPEALWVTVGLSVCLVVLLVALAFVCWRKIKQSCEEENAGAEDQDGDGEGSKTALRPLKPSENKEDDGQEIA

SEQ ID NO: 57 - DNA, 2605 bp, Homo sapiens
gtgagtcaccaaggaaggcagcggcagctccactcagccagtacccagatacgctgggaaccttccccagccatggcttccctggggcagatcctcttctggagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggatagaggccagggatgctgctcaacctcctaccatgtacaggacgtctccccattacaactacccaatccgaagtgtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacacca

SEQ ID NO: 58 - protein, 282 aa, Homo sapiens
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 59 - DNA, 2622 bp, Mus musculus
gtgagtcacaacacccaggagggcagcagcaggcaggcagctccactcaccaaaatctggccccacacacagcaggactgtgggaaggaactccctctccatggcttccttggggcagatcatcttttggagtattattaacatcatcatcatcctggctggggccatcgcactcatcattggctttggcatttcaggcaagcacttcatcacggtcacgaccttcacctcagctggaaacattggagaggacgggaccctgagctgcacttttgaacctgacatcaaactcaacggcatcgtcatccagtggctgaaagaaggcatcaaaggtttggtccacgagttcaaagaaggcaaagacgacctctcacagcagcatgagatgttcagaggccgcacagcagtgtttgctgatcaggtggtagttggcaatgcttccctgagactgaaaaacgtgcagctcacggatgctggcacctacacatgttacatccgcacctcaaaaggcaaagggaatgcaaaccttgagtataagaccggagccttcagtatgccagagataaatgtggactataatgccagttcagagagtttacgctgcgaggctcctcggtggttcccccagcccacagtggcctgggcatctcaagtcgaccaaggagccaatttctcagaagtctccaacaccagctttgagttgaactctgagaatgtgaccatgaaggtcgtatctgtgctctacaatgtcacaatcaacaacacatactcctgtatgattgaaaacgacattgccaaagccaccggggacatcaaagtgacagattcagaggtcaaaaggcgaagtcagctgcagttgctgaactctgggccttccccgtgtgttttttcttctgcctttgtggctggctgggcactcctatctctctcctgttgcctgatgctaagatgaggggccctggctacacaaaagcatgcaacgttgctggtccaacagaatcccggagaactacagaaatattttcctcaagacatgacctagttttatatttctagaagaagatgaaatcatgtctagaagtctggagagagcagacaggaacaagatgtggaaggaaaacaaaagtaacccacagacacccccgatcggaacaagatggacctagaaaataattcaaccaaactagagtatactaagtgtgctgttacaatgtgtgtagggtaggtgtcctcccacatctcaggggcctcccctggtccaccagctcctgagttaggatgggctgttatgatgtcactctgaaggttcctggatggttcctactgccatatactcattttatattcagcacattaaaccatagtgaatgctatgaaaagctgctaatcagctgccactccgagattcggaggtggcaacgtctgagtgacaggtccagtgattcgcttctccttaggatgcttttacaagctctttggcgtctcctcccacctggcaaatgccaaatgcataggggagggtgatcatcattctagggcaaacaaaatagttgagggatgctgatttcccaaatcatccgaatcacttctcccttgagcaaacaagcgccctgttatttctcaaatgctgctttgtgaatcagtccagggcaaggcgctctcctcatcccgctatgtggccttaagtcatcgtaaggtttgaagtttctactttcgatcctgcatggagagctataatctcagctcccccgccccccccacacacacctctgcacacacacccccccccaacactgggagtaaaccaggatgatgtccgtcttctcattccccatgtgaccgttggcagtgtagagagactgattgtcacagctaaaggaagagggacaacagggtcactggtgtctacagagattatattctacgtgtctcactgaatttacacaactccaagtgccaaccacatcaaggtcaggaaatcctgaactggaataagaaagacccagaagatgaatgtgaacagatccatttgcttcccgacagtgggcacagacttcagtctctggctactgttccaagacccagggctctgcaattgtgtgacatccttcagtgaacccacatgggaaattctccatggaattatcttcagcccactgtacttctgaatccctcttccttccttctgtgccacacagcaagtctggcttaaatgctgcctgatctccatttcaagttttctgcctctggatttttagatctcaagaccatggacgaaacatcagttacagcaacaaaagtgaattttccgtgcagagacttctaggggttctgtttgttttcagggtgctagagatcacactcagatgctcatatatgttaggtaaatgttctcccactgagttacagcccagctcacacagagacttctaaaagaaaatacggccatgctctttgaaatggagcattgagggatgaagtttggatggcgaagaaaacttctcaccagctctctccccacattcgtgccaagcactgcctccctagacttcgggtcaccatatctgtactacgttttgatacagaaggctcgagaccattcaagagaattatttagtacac

SEQ ID NO: 60 - protein, 283 aa, Mus musculus
MASLGQIIFWSIINIIIILAGAIALIIGFGISGKHFITVTTFTSAGNIGEDGTLSCTFEPDIKLNGIVIQWLKEGIKGLVHEFKEGKDDLSQQHEMFRGRTAVFADQVVVGNASLRLKNVQLTDAGTYTCYIRTSKGKGNANLEYKTGAFSMPEINVDYNASSESLRCEAPRWFPQPTVAWASQVDQGANFSEVSNTSFELNSENVTMKVVSVLYNVTINNTYSCMIENDIAKATGDIKVTDSEVKRRSQLQLLNSGPSPCVFSSAFVAGWALLSLSCCLMLR

SEQ ID NO: 61 - DNA, 4714 bp, Homo sapiens
agtcgcgggaggcttccccgcgccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggatagtgaaaacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaacaggtgcaaaccctggagatggattgtaagagccagtttaaatctgcactctgctgctcctcccccacccccaccttccactccatacaatctgggcctggtggagtcttcgcttcagagccattcggccaggtgcgggtgatgttcccatctcctgcttgtgggcatgccctggctttgtttttatacacataggcaaggtgagtcctctgtggaattgtgattgaaggattttaaagcaggggaggagagtagggggcatctctgtacactctgggggtaaaacagggaaggcagtgcctgagcatggggacaggtgaggtggggctgggcagaccccctgtagcgtttagcaggatgggggccccaggtactgtggagagcatagtccagcctgggcatttgtctcctagcagcctacactggctctgctgagctgggcctgggtgctgaaagccaggatttggggctaggcgggaagatgttcgcccaattgcttggggggttggggggatggaaaaggggagcacctctaggctgcctggcagcagtgagccctgggcctgtggctacagccagggaaccccacctggacacatggccctgcttctaagccccccagttaggcccaaaggaatggtccactgagggcctcctgctctgcctgggctgggccaggggctttgaggagagggtaaacataggcccggagatggggctgacacctcgagtggccagaatatgcccaaaccccggcttctcccttgtccctaggcagaggggggtcccttcttttgttccctctggtcaccacaatgcttgatgccagctgccataggaagagggtgctggctggccatggtggcacacacctgtcctcccagcactttgcagggctgaggtggaaggaccgcttaagcccaggtgttcaaggctgctgtgagctgtgttcgagccactacactccagcctggggacggagcaaaactttgcctcaaaacaaattttaaaaagaaagaaagaaggaaagagggtatgtttttcacaattcatgggggcctgcatggcaggagtggggacaggacacctgctgttcctggagtcgaaggacaagcccacagcccagattccggttctcccaactcaggaagagcatgccctgccctctggggaggctggcctggccccagccctcagctgctgaccttgaggcagagacaacttctaagaatttggctgccagaccccaggcctggctgctgctgtgtggagagggaggcggcccgcagcagaacagccaccgcacttcctcctcagcttcctctggtgcggccctgccctctcttctctggacccttttacaactgaacgcatctgggcttcgtggtttcctgttttcagcgaaatttactctgagctcccagttccatcttcatccatggccacaggccctgcctacaacgcactagggacgtccctccctgctgctgctggggaggggcaggctgctggagccgccctctgagttgcccgggatggtagtgcctctgatgccagccctggtggctgtgggctggggtgcatgggagagctgggtgcgagaacatggcgcctccagggggcgggaggagcactaggggctggggcaggaggctcctggagcgctggattcgtggcacagtctgaggccctgagagggaaatccatgcttttaagaactaattcattgttaggagatcaatcaggaattaggggccatcttacctatctcctgacattcacagtttaatagagacttcctgcctttattccctcccagggagaggctgaaggaatggaattgaaagcaccatttggagggttttgctgacacagcggggactgctcagcactccctaaaaacacaccatggaggccactggtgactgctggtgggcaggctggccctgcctgggggagtccgtggcgatgggcgctggggtggaggtgcaggagccccaggacctgcttttcaaaagacttctgcctgaccagagctcccactacatgcagtggcccagggcagaggggctgatacatggcctttttcagggggtgctcctcgcggggtggacttgggagtgtgcagtgggacagggggctgcaggggtcctgccaccaccgagcaccaacttggcccctggggtcctgcctcatgaatgaggccttccccagggctggcctgactgtgctgggggctgggttaacgttttctcagggaaccacaatgcacgaaagaggaactggggttgctaaccaggatgctgggaacaaaggcctcttgaagcccagccacagcccagctgagcatgaggcccagcccatagacggcacaggccacctggcccattccctgggcattccctgctttgcattgctgcttctcttcaccccatggaggctatgtcaccctaactatcctggaatgtgttgagagggattctgaatgatcaatatagcttggtgagacagtgccgagatagatagccatgtctgccttgggcacgggagagggaagtggcagcatgcatgctgtttcttggccttttctgttagaatacttggtgctttccaacacactttcacatgtgttgtaacttgtttgatccacccccttccctgaaaatcctgggaggttttattgctgccatttaacacagagggcaatagaggttctgaaaggtctgtgtcttgtcaaaacaagtaaacggtggaactacgactaaa

SEQ ID NO: 62 - protein, 311 aa, Homo sapiens
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 63 - DNA, 4846 bp, Mus musculus
gggggcgctgctgggcggggagcttgctcggccgcctgcctcgccttgggctcagcattcactctagcgagcgagcggcgtgtacagccggctccctgggctcctggagtcccgcttgctccaagcgcactccagcagtctctttctgctcttgcccggctcgacggcgacatgggtgtccccgcggtcccagaggccagcagcccgcgctggggaaccctgctccttgctattttcctggctgcatccagaggtctggtagcagccttcaaggtcaccactccatattctctctatgtgtgtcccgagggacagaatgccaccctcacctgcaggattctgggccccgtgtccaaagggcacgatgtgaccatctacaagacgtggtacctcagctcacgaggcgaggtccagatgtgcaaagaacaccggcccatacgcaacttcacattgcagcaccttcagcaccacggaagccacctgaaagccaacgccagccatgaccagccccagaagcatgggctagagctagcttctgaccaccacggtaacttctctatcaccctgcgcaatgtgaccccaagggacagcggcctctactgctgtctagtgatagaattaaaaaaccaccacccagaacaacggttctacgggtccatggagctacaggtacaggcaggcaaaggctcggggtccacatgcatggcgtctaatgagcaggacagtgacagcatcacggctgcggccctggccaccggcgcctgcatcgtgggaatcctctgcctcccccttatcctgctgctggtctataagcagagacaggtggcctctcaccgccgtgcccaggagttggtgaggatggacagcagcaacacccaaggaatcgaaaacccaggcttcgagaccactccacccttccaggggatgcctgaggccaagaccaggccgccactgtcctatgtggcccagcggcaaccttcggagtcaggacggtacctgctctctgaccccagcacacctctgtcgcctccaggccctggggacgtctttttcccatccctagatccagtccctgactcccctaactctgaagccatctaaaccagctggggaaccatgaaccatggtacctgggtcagggatatgtgcacttgatctatggctggcccttggacagtcttttaggcactgactccagcttccttgctcctgctctgagcctagactctgcttttacaagatgcacagaccctcccctatctctttcagacgctacttggggggcagggagaagatgttggattgctcattgctgttctcaagatcttgggatgctgagttctccctagagacttgacttcgacagccacagatgtcagatgacctgcatcctatgaacgtccggcttggcaagagcctttcttcatggaaaccagtagcccggaggggatgaggtaggcaccttgccaccctcccgggagagagacacaagatgtgagagactcctgctcactgtgggggtgtggctggcctgcttgtttgcctgaggatgctcctctgttggactgactctatccccctggattctggagcttggctggcctatgtcccaccagaggagcatctcagcagccttccaccagcaacctgagggcctgccagcttcgtggctctgggctctcattacctgtatggccgtccacagagctcagtggccagaggctttgaaacaggaagtacatgtcaggttcaggaaccactgtgagctcattagtgtcttgagcaatgtgaggcctggaccagtggacacggagggagggtggcgagaggatgatggggatgatgaggggaacacgctcccttcctgtccttgtcatccaccactaccactattcagtgtggagcagtggcaaaggtgaccgacctccacaatgtcctagtgatgctggaccatttctaagtgtgaaagagatgctattaaaaacagtatgtggcaatggctgccaacagctgagtggactggaggcactggctttaaggccctggaggtgcagggcccggtatggggatagggatgggagtttcagtgagggcctagggatcactccgcttctgaccactcttcttctgagcctcacctcagggtgaccttcaggcacacagaagagcttgcccctggtccgatactactcttggctctcatctccagggtttggcatgacctgggcacacagggggagtcttcagaaaggattttaaagcatgaaaagaaagggtagttcttgtgaggtagggatgggcagctgatgtttgagagtgaggagggatacggctgggcagatcactctccagtctctagagggaaagtagctctaagtctgggagagcagcagcccagtggtaccatatgtcttcttgcagcttccactggctgggctgaactgggcatgggtaggaaagctcctgttctgggcctgcagccagggagaaccccattcattccctgaggacagatgggtggggagagaagagagagtttcaggccgggaagcagcaataagctatctgctggggacccagacaagttgtctgatgaggtccaagatgtgggatgccagttatacctggggcttggggatccttagaggctttgtatcatcatcataggagtgtcggggtggccagggcatcaaagccatgacccctgttttatcctcagggtccactcttctgcaccatccattgctctagatctatgcagttactatagacagaatgtgttgttctgtttggctttggggataatggcctggcgaactgccagctgttcagtggcagggctgtgaggccagtcaaagactagaacccacagaccagctgaacgatgagtatagcctgtcccctgggggagcctgacctgtctccagccctaagcttcagacctcaccactcagatgacttctaagaatttgcctgtggggacccctgcatggctgcagctccgtggaaaggagaggaggcccccagcagaagaaccactcgcttcctgcccagcttcctcctgtagggctctaagtctcttcttcttgggaccctgcaagcaaaggcatgtcagcttggtggtttcctgttttgggtgaagttttgtgtggtccgggttctgtctacatccatgaacttgggtgctaccaccttgctgctgctgtagagacagctgcaggatcttagggtggaaaatggaggtgccctgaggtgctagcccttggggcaaaagatggggtggcaatgagacacagtggggaactgagttccccaagaggagggaggagccctgtagcctcaagggccatattgggttcctggtaccagcaaaagcctagagagcgaagtctgtattttgaggaggtaattgatccttacggaatccatcagaaatttggagcgggtgctttatctatctctggagggtctctacctatctccgatgaagctctccctgggcctgggatgggagaaaccaggaggaaaggtgtctgataaagcaggggcttcttgacaagccaaagggccactggtagctgttgtggaccgagctgaccctgctgaagtattgtagtgtgccttggaccaacttctcaaaagagcaaccccggggctaccctacttctgccaggaagaggcggagaaggggctgagaggcctggaaggggctagctccttctttgagaactgctccccggaggacttggaggaggcggctaggctacgggctgctgagggccctttgtctttcctaacctgggcactgttaggatgctccctcctggaaaaggctttcctgggtgtgagctagagcagtgtccatgccagcgctgaacctgccatggtgggagctgaactaaaaatttctcagggaactaaaataggcaaaagaggaactgggggaggagggtgccaggcaggatggggggaagggagggcagtgcaaaagtctcttgaaacacagacagcccagctgagtgccagtcccagatcacagagaatacggctcatctggctcatgttctgcatgcttgctgctttaccctggcactttccttctccaccatgagtgcgagtcctgggagtcctgggagggtgaggattaatgccagcctggggagcagatagctgacagagtccttgggtaactggcttgaaccaggacctcaggattccactctggggatctagctttgtctgggccagtgaagatctctataatggcattattgccaggggataaacatttcactgggttctgatctgttgggtgtggcttcctggaaaatatggtgagaggaattctgctaaggatacagttgataagaaagttctgagattgattagtaatgcctgccttggactcaggaagggaagtggcagtatgaatgccatgtcttaatcattttggttaaaatatgcttcccaaaagatttccacgtgtgttcttgtttatttgacatctgtctccatatcagtcttgaaagcctttctgtgtgtatatatatgatgtttgcgtgtatatatgtttttgtgtgtgcatatggaagtcagaaatcactgggtgtcttcctccattcctttgcaatgtatgttttttttttttttacgatttatttactatatgaatgttttgcctgaatacatgcataggtgtcacgtacatgcctgctggaacgcttggaactggagttacaggtggctatgagctacagtgtgagcactgggaatcaaacctgggtcttctgcaagagcaacaaattaaaagtcagctcttaactacttgagctatttttccaactcc

SEQ ID NO: 64 - protein, 309 aa, Mus musculus
MGVPAVPEASSPRWGTLLLAIFLAASRGLVAAFKVTTPYSLYVCPEGQNATLTCRILGPVSKGHDVTIYKTWYLSSRGEVQMCKEHRPIRNFTLQHLQHHGSHLKANASHDQPQKHGLELASDHHGNFSITLRNVTPRDSGLYCCLVIELKNHHPEQRFYGSMELQVQAGKGSGSTCMASNEQDSDSITAAALATGACIVGILCLPLILLLVYKQRQVASHRRAQELVRMDSSNTQGIENPGFETTPPFQGMPEAKTRPPLSYVAQRQPSESGRYLLSDPSTPLSPPGPGDVFFPSLDPVPDSPNSEAI

SEQ ID NO: 65 - DNA, 2666 bp, Homo sapiens
agttctcttcaagtcatgtaatcgacttttttgaattagttttcagtttcattttgttttccctaattcaagttgggaacacttcattttccccaattcaagttgggaacacttccttggtatttccttgctacatggactttagcaaatgctactttactctccttccagctactcaggaggctgaggcaggagaatcgcttgaacccgggaggcggaggttacagtgagccttttcctagttttactgttggaagcctaactcacaggagagattatgcaatacagtcctgaagtcaagggaggagagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacacaaa

SEQ ID NO: 66 - protein, 414 aa, Homo sapiens
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHNKGLWILVPSAILAAFLLIWSVKCCRAQLEARRSRHPADGAQQERCCVPPGERCPSAPDNGEENVPLSGKV

SEQ ID NO: 67 - DNA, 2113 bp, Mus musculus
acccttaaataagagctgaagatggctgcagctttctcctagactcctccaggagaaactctaaagccagagcctgggggcagcattgtgtgtccaccttgccactgagaacatctacggaaattggacactctggccccagcatccacacgcttgactgttggccacagtaacacaggtgtggatggtccccagagccagggtccaggagtgcactgaggatccctggggcttcaaggaacccacagctctgtccagacgggaatttttttcctgagaactttcacctgttgccctcctatggtgaacctggacttgaccttccactctgatgatgaagggctccccctccgtccctccagctggttgtctcctccctctgctcctcctgctgtttaccggagtctctggagaagtgtcttggttttctgtgaagggaccagctgagcccatcactgtcctgctggggactgaagccaccctgccctgccagctgtctcctgaacagagtgcagctcgcatgcacatccgatggtaccgtgcccagcccacccctgctgtgctggtgttccacaacggacaggagcagggagaggtgcagatgccggaatacaggggcaggacccagatggtgagacaagccattgacatgggaagtgtggctctgcagatacagcaggtccaggcctctgatgatggcctgtaccactgtcagtttacagatggcttcacctcccaagaggtctccatggagcttcgagtcataggtttaggctctgcccctcttgttcacatgacaggacctgagaatgatgggatccgagtgttgtgctcctcaagtggctggttcccaaaacccaaagtgcaatggagagacacctccgggaacatgctactgtcctcctctgagttgcagacccaagacagagaagggctcttccaggtggaagtgtctcttttggtcacagatagagctattggcaatgtgatctgctccatccaaaatcccatgtatgaccaggagaaatcgaaggccatcctcctcccagagcccttcttccccaagacgtgtccatggaaagtagccctggtttgttctgtcctcatactattggtcctgctcggtgggatcagccttggaatctggaaagaacatcaagtcaaaaggagagaaattaaaaaatggtcaaaggaacatgaagaaatgcttctgttgaagaaggggacaaaatctgtactgaagatcagagatgacctccaggccgacctagatcggaggaaggcgctgtacaaagaagactggaagaaggccttgctgtaccctgactggaggaaggagctgttccaggaggctcctgtgaggataaattatgaaatgcctgaccaggacaagacagactcaaggacagaagagaacagaggtgaggagactgtcagcagctcacaagtagaccacaacctcatcacactctcccaggaaggcttcatgttgggaagatactactgggaggtggatgtcaaggacacagaggagtggacactaggagtttatgagctgtgcactcaggatgcatcacttacagaccccttgaggaaattcagagtcctggaaaagaatggagatggatacagggctcttgacttctgttcccaaaacattaattcggaagaacctctgcaactgaagacacgtccgctgaagatcgccatcttcttggatcaggaagacaatgacctctctttctacaacatgaccgatgagacacacatcttttcctttgcccaggtccctttcttgggatcaccctatccttacttcacacgtaattccatggggctctctgcaacagcacagccctaagtgatgtgcacagggaattcaatgggtgggtgctgcagcgtgctacccgtaaggccctcttaggcaggcacagggggcctctgaccaagaggcctcttaacctgagactccatgagcctcggggatcagatcctggacaagattctcggaccatctgtgtcgtgcatggtgttatagttattaatagccttccttcttttgacaaaaatgtgtttaatcattcctaagataaatgaatccatggctttctga

SEQ ID NO: 68 - protein, 509 aa, Mus musculus
MMKGSPSVPPAGCLLPLLLLLFTGVSGEVSWFSVKGPAEPITVLLGTEATLPCQLSPEQSAARMHIRWYRAQPTPAVLVFHNGQEQGEVQMPEYRGRTQMVRQAIDMGSVALQIQQVQASDDGLYHCQFTDGFTSQEVSMELRVIGLGSAPLVHMTGPENDGIRVLCSSSGWFPKPKVQWRDTSGNMLLSSSELQTQDREGLFQVEVSLLVTDRAIGNVICSIQNPMYDQEKSKAILLPEPFFPKTCPWKVALVCSVLILLVLLGGISLGIWKEHQVKRREIKKWSKEHEEMLLLKKGTKSVLKIRDDLQADLDRRKALYKEDWKKALLYPDWRKELFQEAPVRINYEMPDQDKTDSRTEENRGEETVSSSQVDHNLITLSQEGFMLGRYYWEVDVKDTEEWTLGVYELCTQDASLTDPLRKFRVLEKNGDGYRALDFCSQNINSEEPLQLKTRPLKIAIFLDQEDNDLSFYNMTDETHIFSFAQVPFLGSPYPYFTRNSMGLSATAQP

SEQ ID NO: 69 - DNA, 1818 bp, Homo sapiens
actcattgcaccttcctgccaccccaggcagtgtctgggccctcagctccccctccctccacctaccccctcacacccaccactacgaccccacgggatacccagcccagacggaggaaacaccgagcctagagacatgagagttggaggagcattccaccttctactcgtgtgcctgagcccagcactgctgtctgctgtgcggatcaacggggatggacaggaggtcctgtacctggcagaaggtgataatgtgaggctgggctgcccctacgtcctggaccctgaggactatggtcccaatgggctggacatcgagtggatgcaggtcaactcagaccccgcccaccaccgagagaacgtgttccttagttaccaggacaagaggatcaaccatggcagccttccccatctgcagcagagggtccgctttgcagcctcagacccaagccagtacgatgcctccatcaacctcatgaacctgcaggtatctgatacagccacttatgagtgccgggtgaagaagaccaccatggccacccggaaggtcattgtcactgtccaagcacgacctgcagtgcccatgtgctggacagagggccacatgacatatggcaacgatgtggtgctgaagtgctatgccagtgggggctcccagcccctctcctacaagtgggccaagatcagtgggcaccattacccctatcgagctgggtcttacacctcccagcacagctaccactcagagctgtcctaccaggagtccttccacagctccataaaccaaggcctgaacaatggggacctggtgttgaaggatatctccagagcagatgatgggctgtatcagtgcacagtggccaacaacgtgggctacagtgtttgtgtggtggaggtgaaggtctcagactcccggcgtataggcgtgatcatcggcatcgtcctgggctctctgctcgcgctgggctgcctggccgtaggcatctgggggctcgtctgctgctgctgcgggggctccggggctggcggcgcccgcggtgccttcggctacggcaacggcggcggggtcggcggaggggcctgcggcgacttggctagtgagatcagagaggacgccgtggcgcccgggtgcaaggccagcgggcgcggcagccgcgtcacccacctcctggggtacccgacgcagaacgtcagccgctccctgcgccgcaagtacgcgcctcccccctgcggcggccccgaggacgtggccctggcgccctgcaccgccgccgccgcctgcgaagcgggcccctccccggtctacgtcaaggtcaagagcgcggagccggctgactgcgccgaggggccggtgcagtgcaagaacggcctcttggtgtgagcgcgcgcgccgggccgggctgcgccccagccaggaggagggcgcggggctctctgtctgcagctggggacacgtcggggctggggacgacctcgctcgccccaggctgccaggcggctgggggtgaaggcatttccctaaggaaatgcgtagggaggcagagcctcctccccaaaagtgggaaggggcgggcgagggcggaggaaggcgatcctgagccttctccgcacccccgggaccgaaggcttgggggagagggagggaggaggaggctgagtgtcctagagcggctgaggccggaggcctggtgtccccagcctaagcagagggccccgggggccgggtgggtgggggtctgtctggacgaattgttctgtgtgtgaggtctgagctctgaggcagcagtgttagcacaataaagaaacattgagacgtga

SEQ ID NO: 70 - protein, 414 aa, Homo sapiens
MRVGGAFHLLLVCLSPALLSAVRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 71 - DNA, 1814 bp, Mus musculus
actcattgcatcttcctgccaccccgggcagtgtctgggccctccgctccccctccctccacctgccccttccacccaccaccaccagcccactggagcccagctcaggcggaggaaagaccaagcctagagacatgggagttcgaggagcactccatcttctacttgtgtgcctgagcccagcactgttgtctgctgtaaggatcaacggggatggccaggaggtcatgtacctggcagaaggtgacaatgtgaggctaggctgtccctacctcctggatcctgaggatttgggtaccaacagtctggacattgagtggatgcaagtcaactcagagccctcacacagggagaatgtttttcttacttatcaagacaagaggataggtcatggcaacctcccccatctgcagcagagggtccgctttgcagcctcagaccccagccagtacgatgcctccatcaacctcatgaacctgcaggtatctgacacagcaacctatgagtgccgggtgaagaagaccaccatggccaccaggaaggtcattgtcactgtccaagcacgtcctgcggtgcccatgtgttggacggaaggccacatgtcaaagggcaacgatgtggtgctgaagtgctttgccaacggaggctctcagcccctctcctacaagtgggccaagatcagtgggcacagtcacccctaccgagctggggcttaccactcacagcacagcttccactctgagctttcttaccaagagtcattccacagcaccatcaaccaaggcctgggcaacggagacctgctgttgaagggcatcaacgcagacgacgatgggctgtatcagtgcacagtggccaaccatgtgggctacagcgtctgtgtggtagaggtgaaagtctcagactcccagcgagtaggcatgatcgttggagcagtgctgggctctttgctcatgctggcctgcctggcactaggcatctgggggctcatctgctgctgctgcggaggcggcggggccggtggtgcccgaggtgccttcggctacggggtcggcggcggggtcggcggaggggcctgcggcgacttggctagtgagatcagagtggacgccgaggcgcccgggtgtaaggccagcgggcgcggcagccgcgtcacccacctcctggggtacccgacgcagaacgtcagccgctccctgcgccgcaagtacgcgcctccgccctgcggcggccccgaggacgtggccctagtgccccgcaccgcctccgcctcctgcgaagcgggtccctcccccgtctacatcaaggtcaagagcgcggagccggccgactgcgccgactgtgcccaggtcgagcagcgctcgtgcaaggacggcctcttagtgtgagcgcacagcaccgggctgcgccccggctgggaggtggttcgggggctctctgcccgcagctggggacaggttcgggccagcagacctggctctctcattggccacctagcggtggtaaggaaatttccctctgagaagccaagccgggcagaccctcctcccctgtagtgggaggagaggcgggggagacagaaaacagttcagagctctccctcacccctggtttccagggagaggaagggagaggagagctgtcggtatcccagaaccgcagaggtacaacccagatgtccccagccaaggcgagggccccccagccctgggtaggtggatgtcagggctgaattgctctgtgtgtgagatctgagctccaaggcaacagtgttagcacaataaagaaacttaaagactgaaaaaaaaaaaaaa

SEQ ID NO: 72 - protein, 417 aa, Mus musculus
MGVRGALHLLLVCLSPALLSAVRINGDGQEVMYLAEGDNVRLGCPYLLDPEDLGTNSLDIEWMQVNSEPSHRENVFLTYQDKRIGHGNLPHLQQRVRFAASDPSQYDASINLMNLQVSDTATYECRVKKTTMATRKVIVTVQARPAVPMCWTEGHMSKGNDVVLKCFANGGSQPLSYKWAKISGHSHPYRAGAYHSQHSFHSELSYQESFHSTINQGLGNGDLLLKGINADDDGLYQCTVANHVGYSVCVVEVKVSDSQRVGMIVGAVLGSLLMLACLALGIWGLICCCCGGGGAGGARGAFGYGVGGGVGGGACGDLASEIRVDAEAPGCKASGRGSRVTHLLGYPTQNVSRSLRRKYAPPPCGGPEDVALVPRTASASCEAGPSPVYIKVKSAEPADCADCAQVEQRSCKDGLLV

SEQ ID NO: 73 - DNA, 3523 bp, Homo sapiens
agtcctggggcagggctgggtggcacggctggcgagcccggaacgcctctggtcacagctcagcgtccgcggagccgggcggcgctgcagctgcacttggctcgtctgtgggtctgacagtcccagctctgcgcggggaacagcggcccggcgctgggtgtgggaggaccaggctgccccaagagcgcggagactcacgcccgctcctctcctgttgcgaccgggagccgggtaggaggcaggcgcgctccctgcggccccgggatgacttctcagcgttcccctctggcgcctttgctgctcctctctctgcacggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcaccccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcatataaaataagttgtcattaattatcaatactaacgagtatgtcattttaaaacttagtattctctttaatgttacaaga

SEQ ID NO: 74 - protein, 431 aa, Homo sapiens
MTSQRSPLAPLLLLSLHGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISPQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 75 - DNA, 3430 bp, Mus musculus
cggctggtggtggccgcggcggccggcgagcccgggacgcccgagcctgccccgagcctcggcggagcggagtggcctcggcgctcccgtgtcccgcttggtcccacgctgcaccccgccgcccaggagcccggcggacggcggctcccccggcggctccggcatgactcggcggcgctccgctccggcgtcctggctgctcgtgtcgctgctcggtgtcgcaacatccctggaagtgtccgagagcccaggcagtgtccaggtggcccggggccagacagcagtcctgccctgcgccttctccaccagtgctgccctcctgaacctcaatgtcatttggatggtcattcccctctccaatgcaaaccagcccgaacaggtcattctttatcagggtggacaaatgtttgacggcgccctccggttccacgggagggtaggatttaccggcaccatgcctgctaccaatgtctcgatcttcatcaataacacacagctgtcagatacgggcacgtaccagtgcttggtgaataaccttccagacagagggggcagaaacatcggggtcactggcctcacagtgttagtccccccttctgctccacaatgccaaatccaaggatcccaggacctcggcagtgacgtcatccttctgtgtagttcagaggaaggcatccctcggcccacgtacctttgggagaagttagataatacgctcaagctacctccaacagccactcaggaccaggtccagggaacagtcaccatccggaatatcagtgccctctcttccggtctgtaccagtgtgtggcttctaatgccatcgggaccagcacctgtctgctggacctccaggttatctcaccccagccccggagcgttggagtaatagccggagcggttggcaccggtgctgttcttatcgtcatctgccttgcactaatttcaggggcgttcttttactggagaagcaaaaacaaagaggaggaggaggaagaaattcctaatgaaatcagagaggatgatcttccccctaaatgctcttctgccaaagccttccacacggagatatcctcctcagaaaataacacgctgacctcttccaatacctacaacagtcgatactggaacaacaatccaaaaccccatagaaacacagagtctttcaaccacttcagtgacttacgccagtctttctctggcaatgcagttatcccatcaatctatgcaaatgggaaccatctggttttgggtccacataagactctggtagttacagccaacagagggtcatcacctcaggtcttgcccaggaacaatggttcagtcagcaggaagccttggcctcaacacactcattcctacacagtaagccaaatgaccctggagcgcatcggtgcagtgcctgtcatggtgcctgcccagagtcgagcagggtccctggtataggatgactgaggaaaccatgttcagaagagaataaatggaccgccttcaggcaaggggggagcactgccttcaggcaaggggggagcactgccttcaggcaagagggagagtgggatgggtgagtgctgaaaaataaacttttgttacgattccattagcaaaaagcacaaagaggaggcgtgtgtgaagtggcctggggttgttccataatgaagactcaagaagactgtttccccaccacagatgtcctgagattcagttaaaacgaaacatgctgcatctccagagatgtgccaagccaaggagaatgctagaagcagagtaaagcttaccccccaaactgtggtccagctggaccccttctttaattcttgcctaacttaattattttcaggacccttcaagtgccaggtggaatttacataatgaaattattttttaaaaataggtgtccttagggagagaaaacaggagcaagctcatggtctggcctagtctccctctcccactccttctgatgacactagcaatgcattccatctgacctgactttatcatagaggcaaaattgttcagaacactggctggagatggggagaaataaggaaacttcttgtgaacaccctacacacacacacacacacacacacacacacacacacacacacacacacacacacacacacacatttatttacctcctcctgaaccatgaatcgtattggtgattttgctatattgacagattctcatctgttacactctaggatctctcacaggtctgtggcaattactgttcatgatttcctgaaaaaatatttttttaaaagaaaactattttttttaaatactagagagacagtggactaggaaagcgagaacttgccgccttgtctagtgactgtattcaatgactgaacagaggccccccccaccatacaagagttttaggtgattgagtgggtggaaccagctggagccaggtgggaggggcctttacattgccagcagggccccaaagaattgagattgtgtatggcaaccgttaatgaggacagcgcctgatgccttttgtaccgaggaagataattgcctcttgtttgacaagtagagtttagtaggttattacaaaaagggcaagagttgttttggttttgtttctttcaaaataattttttttcaaaagaataacaagggttaggcaaatgggggaccttcctgtgtgctcttgggggtctgctcagcatctggaaatttgggtgtgcgattttccctgaacacattgcataccagtgtaaaaagactctgcctcccccctttttggcttttttactgggcttggctggccttgcagtttaccagattcatttacagactctctgctctgtatggcgccgcctgccatgtctgtcttggtgactatcctgccttaatcactttgctttagggcaactcatggtgatctcttccaagatctgtttttaaattgtttggactacttgagccacaactctcagaggacattcctttttttttttttttttttttctcctttcttccattgctttgtccctcttcccctgtgcttcctgccttctttccctgtcccatgggcacagtcctcacagggagtggcctcctctctccagtgatgtaagtgaatggaagccatcactggctgcacatacctttttcaaaagggacactcgggaagtcactgctgtgaccgtttcgatgttgataagaaggtgaatttactgtagtgttaccaccttctccccacttgatggttcttgactttgtaaaaatttaaataaatgaatgtctatactttttaaggaaaagagaaaataccatgtcacagaaaaggtgaaactattagatgctgtttagaaagcatttatcttgcatttctttattctttctaattacctaaaattcaataaaagtttattcatataaaaaaaaaaaaaaaaaaaa

SEQ ID NO: 76 - protein, 428 aa, Mus musculus
MTRRRSAPASWLLVSLLGVATSLEVSESPGSVQVARGQTAVLPCAFSTSAALLNLNVIWMVIPLSNANQPEQVILYQGGQMFDGALRFHGRVGFTGTMPATNVSIFINNTQLSDTGTYQCLVNNLPDRGGRNIGVTGLTVLVPPSAPQCQIQGSQDLGSDVILLCSSEEGIPRPTYLWEKLDNTLKLPPTATQDQVQGTVTIRNISALSSGLYQCVASNAIGTSTCLLDLQVISPQPRSVGVIAGAVGTGAVLIVICLALISGAFFYWRSKNKEEEEEEIPNEIREDDLPPKCSSAKAFHTEISSSENNTLTSSNTYNSRYWNNNPKPHRNTESFNHFSDLRQSFSGNAVIPSIYANGNHLVLGPHKTLVVTANRGSSPQVLPRNNGSVSRKPWPQHTHSYTVSQMTLERIGAVPVMVPAQSRAGSLV

SEQ ID NO: 77 - DNA, 1807 bp, Homo sapiens
acagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaa

SEQ ID NO: 78 - protein, 399 aa, Homo sapiens
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAARAHAREANDSGETMRVAIFASGCSSDEPTSQNLGNNYSDEPCIGQEYQIIAQINGNYARLLDTVPLDYEFLATEGKSVC

SEQ ID NO: 79 - DNA, 1434 bp, Mus musculus
agctaccagcacttccaggttcttcagcagcaagaggatggaaggatgaatagaagtagcttcaaataggatggagatctcatcaggcttgctgttcctgggccacctaatagtgctcacctatggccaccccaccctaaaaacacctgagagtgtgacagggacctggaaaggagatgtgaagattcagtgcatctatgatcccctgagaggctacaggcaagttttggtgaaatggctggtaagacacggctctgactccgtcaccatcttcctacgtgactccactggagaccatatccagcaggcaaagtacagaggccgcctgaaagtgagccacaaagttccaggagatgtgtccctccaaataaataccctgcagatggatgacaggaatcactatacatgtgaggtcacctggcagactcctgatggaaaccaagtaataagagataagatcattgagctccgtgttcggaaatataatccacctagaatcaatactgaagcacctacaaccctgcactcctctttggaagcaacaactataatgagttcaacctctgacttgaccactaatgggactggaaaacttgaggagaccattgctggttcagggaggaacctgccaatctttgccataatcttcatcatctccctttgctgcatagtagctgtcaccataccttatatcttgttccgctgcaggacattccaacaagagtatgtctatggagtgagcagggtgtttgccaggaagacaagcaactctgaagaaaccacaagggtgactaccatcgcaactgatgaaccagattcccaggctctgattagtgactactctgatgatccttgcctcagccaggagtaccaaataaccatcagatcaacaatgtctattcctgcctgctgaacacagtttccagaaactaagaagttcttgctactgaagaaaataacatctgctaaaatgcccctactaagtcaaggtctactggcgtaattacctgttacttatttactacttgccttcaacatagctttctccctggcttcctttcttcttagacaacctaaagtatctatctagtctgccaattctggggccattgagaaatcctgggtttggctaagaatatactacatgcacctcaagaaatctagcttctgggcttcacccagaacaattttcttcctagggccttcacaactcttctccaaacagcagagaaattccatagcagtagaggttctttatcatgcctccagacagcgtgagtctcagtcctacaaactcagacaagcacatgggtctaggattactcctctttctctagggccagatgacttttaattgatattactattgctacattatgaatctaatgcacatgtattcttttgttgttaataaatgtttaatcatgacatcaa

SEQ ID NO: 80 - protein, 280 aa, Mus musculus
MEISSGLLFLGHLIVLTYGHPTLKTPESVTGTWKGDVKIQCIYDPLRGYRQVLVKWLVRHGSDSVTIFLRDSTGDHIQQAKYRGRLKVSHKVPGDVSLQINTLQMDDRNHYTCEVTWQTPDGNQVIRDKIIELRVRKYNPPRINTEAPTTLHSSLEATTIMSSTSDLTTNGTGKLEETIAGSGRNLPIFAIIFIISLCCIVAVTIPYILFRCRTFQQEYVYGVSRVFARKTSNSEETTRVTTIATDEPDSQALISDYSDDPCLSQEYQITIRSTMSIPAC

SEQ ID NO: 81 - DNA, 2237 bp, Homo sapiens
atttggagagttaaaactgtgcctaacagaggtgtcctctgacttttcttctgcaagctccatgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagccaaggtcacccctgcaccgactcggcagagagacttcactgcagcctttccaaggatgcttaccaccaggggacatggcccagcagagacacagacactggggagcctccctgatataaatctaacacaaatatccacattggccaatgagttacgggactctagattggccaatgacttacgggactctggagcaaccatcagaataggcatctacatcggagcagggatctgtgctgggctggctctggctcttatcttcggcgctttaattttcaaatggtattctcatagcaaagagaagatacagaatttaagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatagatccaaccaccttatttttgagcttggtgttttgtctttttcagaaactatgagctgtgtcacctgactggttttggaggttctgtccactgctatggagcagagttttcccattttcagaagataatgactcacatgggaattgaactgggacctgcactgaacttaaacaggcatgtcattgcctctgtatttaagccaacagagttacccaacccagagactgttaatcatggatgttagagctcaaacgggcttttatatacactaggaattcttgacgtggggtctctggagctccaggaaattcgggcacatcatatgtccatgaaacttcagataaactagggaaaactgggtgctgaggtgaaagcataacttttttggcacagaaagtctaaaggggccactgattttcaaagagatctgtgatccctttttgttttttgtttttgagatggagtcttgctctgttgcccaggctggagtgcaatggcacaatctcggctcactgcaagctccgcctcctgggttcaagcgattctcctgcctcagcctcctgagtggctgggattacaggcatgcaccaccatgcccagctaatttgttgtatttttagtagagacagggtttcaccatgttggccagtgtggtctcaaactcctgacctcatgatttgcctgcctcggcctcccaaagcactgggattacaggcgtgagccaccacatccagccagtgatccttaaaagattaagagatgactggaccaggtctaccttgatcttgaagattcccttggaatgttgagatttaggcttatttgagcactgcctgcccaactgtcagtgccagtgcatagcccttcttttgtctcccttatgaagactgccctgcagggctgagatgtggcaggagctcccagggaaaaacgaagtgcatttgattggtgtgtattggccaagttttgcttgttgtgtgcttgaaagaaaatatctctgaccaacttctgtattcgtggaccaaactgaagctatatttttcacagaagaagaagcagtgacggggacacaaattctgttgcctggtggaaagaaggcaaaggccttcagcaatctatattaccagcgctggatcctttgacagagagtggtccctaaacttaaatttcaagacggtataggcttgatctgtcttgcttattgttgccccctgcgcctagcacaattctgacacacaattggaacttactaaaaatttttttttactgtt

SEQ ID NO: 82 - protein, 301 aa, Homo sapiens
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 83 - DNA, 2725 bp, Mus musculus
accattttaaccgaggagctaaagctatccctacacagagctgtccttggatttcccctgccaagtactcatgttttcaggtcttaccctcaactgtgtcctgctgctgctgcaactactacttgcaaggtcattggaaaatgcttatgtgtttgaggttggtaagaatgcctatctgccctgcagttacactctatctacacctggggcacttgtgcctatgtgctggggcaagggattctgtccttggtcacagtgtaccaacgagttgctcagaactgatgaaagaaatgtgacatatcagaaatccagcagataccagctaaagggcgatctcaacaaaggagacgtgtctctgatcataaagaatgtgactctggatgaccatgggacctactgctgcaggatacagttccctggtcttatgaatgataaaaaattagaactgaaattagacatcaaagcagccaaggtcactccagctcagactgcccatggggactctactacagcttctccaagaaccctaaccacggagagaaatggttcagagacacagacactggtgaccctccataataacaatggaacaaaaatttccacatgggctgatgaaattaaggactctggagaaacgatcagaactgctatccacattggagtgggagtctctgctgggttgaccctggcacttatcattggtgtcttaatccttaaatggtattcctgtaagaaaaagaagttatcgagtttgagccttattacactggccaacttgcctccaggagggttggcaaatgcaggagcagtcaggattcgctctgaggaaaatatctacaccatcgaggagaacgtatatgaagtggagaattcaaatgagtactactgctacgtcaacagccagcagccatcctgaccgcctctggactgccacttttaaaggctcgccttcatttctgactttggtatttccctttttgaaaactatgtgatatgtcacttggcaacctcattggaggttctgaccacagccactgagaaaagagttccagttttctggggataattaactcacaaggggattcgactgtaactcatgctacattgaaatgctccattttatccctgagtttcagggatcggatctcccactccagagacttcaatcatgcgtgttgaagctcactcgtgctttcatacattaggaatggttagtgtgatgtctttgagacatagaggtttgtggtatatctgcaaagctcctgaacaggtagggggaataaagggctaagataggaaggtgaggttctttgttgatgttgaaaatctaaagaagttggtagcttttctagagatttctgaccttgaaagattaagaaaaagccaggtggcatatgcttaacactatataacttgggaaccttaggcaggagggtgataagttcaaggtcagccagggctatgctggtaagactgtctcaaaatccaaagacgaaaataaacatagagacagcaggaggctggagatgaggctcggacagtgaggtgcattttgtacaagcacgaggaatctatatttgatcgtagaccccacatgaaaaagctaggcctggtagagcatgcttgtagactcaagagatggagaggtaaaggcacaacagatccccggggcttgcgtgcagtcagcttagcctaggtgctgagttccaagtccacaagagtccctgtctcaaagtaagatggactgagtatctggcgaatgtccatgggggttgtcctctgctctcagaagagacatgcacatgaacctgcacacacacacacacacacacacacacacacacacacacacacacacacacacacatgaaatgaaggttctctctgtgcctgctacctctctataacatgtatctctacaggactctcctctgcctctgttaagacatgagtgggagcatggcagagcagtccagtaattaattccagcactcagaaggctggagcagaagcgtggagagttcaggagcactgtgcccaacactgccagactcttcttacagaagaaaaaggttacccgcaagcagcctgctgtctgtaaaaggaaaccctgcgaaaggcaaactttgactgttgtgtgctcaaggggaactgactcagacaacttctccattcctggaggaaactggagctgtttctgacagaagaacaaccggtgactgggacatacgaaggcagagctcttgcagcaatctatatagtcagcaaaatattctttgggaggacagtcgtcaccaaattgatttccaagccggtggacctcagtttcatctggcttacagctgcctgcccagtgcccttgatctgtgctggctcccatctataacagaatcaaattaaatagaccccgagtgaaaatattaagtgagcagaaaggtagctttgttcaaagatttttttgcattggggagcaactgtgtacatcagaggacatctgttagtgaggacaccaaaacctgtggtaccgttttttcatgtatgaattttgttgtttaggttgcttctagctagctgtggaggtcctggctttcttaggtgggtatggaagggagaccatctaacaaaatccattagagataacagctctcatgcagaagggaaaactaatctcaaatgttttaaagtaataaaactgtactggcaaagtactttgagcatatttaaa

SEQ ID NO: 84 - protein, 281 aa, Mus musculus
MFSGLTLNCVLLLLQLLLARSLENAYVFEVGKNAYLPCSYTLSTPGALVPMCWGKGFCPWSQCTNELLRTDERNVTYQKSSRYQLKGDLNKGDVSLIIKNVTLDDHGTYCCRIQFPGLMNDKKLELKLDIKAAKVTPAQTAHGDSTTASPRTLTTERNGSETQTLVTLHNNNGTKISTWADEIKDSGETIRTAIHIGVGVSAGLTLALIIGVLILKWYSCKKKKLSSLSLITLANLPPGGLANAGAVRIRSEENIYTIEENVYEVENSNEYYCYVNSQQPS

SEQ ID NO: 85 - DNA, 1330 bp, Homo sapiens
agactcctgggtccggtcaaccgtcaaaatgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgttgagtctacttctgctgacactgtcctgctgacatccaaagagtccaaagtttgggatctcccatcaacatcccacgtgtcaatgtggaaaacgagtgattctgtgtcttctcctcagcctggagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtagatttccttgtttcataaaaaagactcacttattccatggatgtcattgatccaggcttgctttagtttcatgaatgaagggtactttagagaccacaa

SEQ ID NO: 86 - protein, 378 aa, Homo sapiens
MSKEPLILWLMIEFWWLYLTPVTSETVVTEVLGHRVTLPCLYSSWSHNSNSMCWGKDQCPYSGCKEALIRTDGMRVTSRKSAKYRLQGTIPRGDVSLTILNPSESDSGVYCCRIEVPGWFNDVKINVRLNLQRASTTTHRTATTTTRRTTTTSPTTTRQMTTTPAALPTTVVTTPDLTTGTPLQMTTIAVFTTANTCLSLTPSTLPEEATGLLTPEPSKEGPILTAESETVLPSDSWSSVESTSADTVLLTSKESKVWDLPSTSHVSMWKTSDSVSSPQPGASDTAVPEQNKTTKTGQMDGIPMSMKNEMPISQLLMIIAPSLGFVLFALFVAFLLRGKLMETYCSQKHTRLDYIGDSKNVLNDVQHGREDEDGLFTL

SEQ ID NO: 87 - DNA, 2175 bp, Mus musculus
agatcctatcaaaatgtccaaggggcttctcctcctctggctggtgacggagctctggtggctttatctgacaccagctgcctcagaggatacaataatagggtttttgggccagccggtgactttgccttgtcattacctctcgtggtcccagagccgcaacagtatgtgctggggcaaaggttcatgtcccaattccaagtgcaatgcagagcttctccgtacagatggaacaagaatcatctccaggaagtcaacaaaatatacacttttggggaaggtccagtttggtgaagtgtccttgaccatctcaaacaccaatcgaggtgacagtggggtgtactgctgccgtatagaggtgcctggctggttcaatgatgtcaagaagaatgtgcgcttggagctgaggagagccacaacaaccaaaaaaccaacaacaaccacccggccaaccaccaccccttatgtgaccaccaccaccccagagctgcttccaacaacagtcatgaccacatctgttctcccaaccaccacaccaccccagacactagccaccactgccttcagtacagcagtgaccacgtgcccctcaacaacacctggctccttctcacaagaaaccacaaaagggtccgccttcactacagaatcagaaactctgcctgcatccaatcactctcaaagaagcatgatgaccatatctacagacatagccgtactcaggcccacaggctctaaccctgggattctcccatccacttcacagctgacgacacagaaaacaacattaacaacaagtgagtctttgcagaagacaactaaatcacatcagatcaacagcagacagaccatcttgatcattgcctgctgtgtgggatttgtgctaatggtgttattgtttctggcgtttctccttcgagggaaagtcacaggagccaactgtttgcagagacacaagaggccagacaacactgaagatagtgacagcgtcctcaatgacatgtcacacgggagggatgatgaagacgggatcttcactctctgactcaccatctttatttaggattaaggatagggaatggcacttgaattgtcaaaataagtttggggacattgtaatttccgtttaaagtctcactctgtttactgatgctgtgggtcctgtctggttgtatcttcccacatgaaggtgctttagagacacattttccctgcctcgtgccttagtcctctttgttgttttgtggctaggtgacttttcacactgggcttgaacactgtcagtgatggtgaaatccttgccacagctttgggagtctcttgcagtctcccagcagtagagggagttagaaatatccagaggggaaaaaaaaatctctcttttcagacagtatctgctttattggtggtagctgaacttcatttatacagagctcctttaacctgtctgtcttcttcttggtatctaagctgccttttgtttttgtttttgtttttgtttttatgatattaacttcttttcacattcaagtttctttaaagttgactatagtgccttctgaactcttgcagagagtttggattttggaagctgccaggtacccatcacagcaggggtgccagtgacaaggatggtgtacaaatgaaacactgaagctatccaaataaattcctctaagtgtaattcattttactgcagcacaggaagaacaaatttgtcttacaactttaataattagtaccattatgaaccctaggagagaaataagagcaaatacctgttgaataaatgaatgtaagaaaatgtgtgtctgagcaagaatactctgtctggctactatgggaagctagctagatctgaaagacattctcagactatcctcatgttcaaggcattaaaggaataagcctccagcccctaaccttaggagaattctgcagtcaagtgaggagtttttaaaacaggaatctctaggttccagtcctctagctattcttttatgcttagtccaggtaatgagttgaacatccaagtattttttaaggacccaaagaaatgcaaccagagctattaccagaattttggagtggtcctcctagagttgccgcatgttgctgggaaaattggggtcttagagttcttagtctacttaataaaagaattttaaaaaatgg

SEQ ID NO: 88 - protein, 343 aa, Mus musculus
MSKGLLLLWLVTELWWLYLTPAASEDTIIGFLGQPVTLPCHYLSWSQSRNSMCWGKGSCPNSKCNAELLRTDGTRIISRKSTKYTLLGKVQFGEVSLTISNTNRGDSGVYCCRIEVPGWFNDVKKNVRLELRRATTTKKPTTTTRPTTTPYVTTTTPELLPTTVMTTSVLPTTTPPQTLATTAFSTAVTTCPSTTPGSFSQETTKGSAFTTESETLPASNHSQRSMMTISTDIAVLRPTGSNPGILPSTSQLTTQKTTLTTSESLQKTTKSHQINSRQTILIIACCVGFVLMVLLFLAFLLRGKVTGANCLQRHKRPDNTEDSDSVLNDMSHGRDDEDGIFTL

SEQ ID NO: 89 - DNA, 3491 bp, Homo sapiens
agcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcga

SEQ ID NO: 90 - protein, 526 aa, Homo sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 91 - DNA, 3736 bp, Mus musculus
aaagctcctttaagaaaagcagggcagatatcagggcagcctggcttagcagtagtgttggagaagaagctagcaggcaggcagcagagacatggagctggcctcagcacatctccacaaagggcaggttccctggggaggactactgctcacagcctcacttttagcctcctggagccctgccaccactgctgaagtcaccattgaggctgtgccgccccaggttgctgaagacaacaatgttcttctacttgttcacaatctgcccctggcgcttggagcctttgcctggtacaagggaaacactacggctatagacaaagaaattgcacgatttgtaccaaatagtaatatgaatttcacggggcaagcatacagcggcagagagataatatacagcaatggatccctgctcttccaaatgatcaccatgaaggatatgggagtctacacactagatatgacagatgaaaactatcgtcgtactcaggcgactgtgcgatttcatgtacaccccatattattaaagcccaacatcacaagcaacaactccaatcccgtggagggtgacgactccgtatcattaacctgtgactcttacactgaccctgataatataaactacctgtggagcagaaatggtgaaagcctttcagaaggtgacaggctgaagctgtctgagggcaacaggactctcactttactcaatgtcacgaggaatgacacaggaccctatgtgtgtgaaacccggaatccagtgagtgtcaaccgaagtgacccattcagcctgaacattatctatggtccggacaccccgattatatccccctcagatatttatttgcatccagggtcaaacctcaacctctcctgccatgcagcctctaacccacctgcacagtacttttggcttatcaatgagaagccccatgcatcctcccaagagctctttatccccaacatcactactaataatagcggaacctatacctgcttcgtcaataactctgtcactggcctcagtaggaccacagtcaagaacattacagtccttgagccagtgactcagcccttcctccaagtcaccaacaccacagtcaaagaactagactctgtgaccctgacctgcttgtcgaatgacattggagccaacatccagtggctcttcaatagccagagtcttcagctcacagagagaatgacactctcccagaacaacagcatcctcagaatagaccctattaagagggaagatgccggcgagtatcagtgtgaaatctcgaatccagtcagcgtcaggaggagcaactcaatcaagctggacataatatttgacccaacacaaggaggcctctcagatggcgccattgctggcatcgtgattggagttgtggctggggtggctctaatagcagggctggcatatttcctctattccaggaagtctggcgggggaagtgaccagcgagatctcacagagcacaaaccctcagcctccaaccacaatctggctccttctgacaactctcctaacaaggtggatgacgtcgcatacactgtcctgaacttcaattcccagcaacccaaccggccaacttcagccccttcttctccaagagccacagaaacagtttattcagaagtaaaaaagaagtgagcataatctgtccgtctgtcctgctggctgcaccagtgatgcattcccggattctgttcctcactggagggtctcagcacacacacacacgtacacatgcgcgcgcgcacacacacacacacacacacacacacacacttacacacacactcatgcattcactctattgactccttcagtgtctatagaagaaaaggtggatcctggagcctacagaaaactcaacccttctaggctttcaaatttggctgagagtgaggtatcaaaatttctcaccctttcactttcctgacccagattgttgaaaattgacctattcagagcaccttcattcccctcccaactccaagtcctgccctatcagagtctgacttgaatttccataaaccttggaggtcacctaagtgcttacgccaaacaaaacaaaacaaaacaaaacaaaacaaaacaaaacaaaacaaaacaaaccagaagcaggaaatggccagtcccatatctttaaaggctgattggaagccaccatacatgagaagatcaaacctccatgggcaatctacacacccgacaactgtcatgcttacccatctgggacattcgagtctctgaaccttgtgccctcacgcctgagcccttctctgagcctttctccagaaaatccactcacagcaactagagaggctctttgtcagcaactccaagcaaactgctaggcaggattcagaagaaaagacagcatctctaacatccaccaggaaggtgcccagaaaagcagagctggtgactttggactgacagacatctggagtgtgaaaaagcagcacagagctaaccttcggagagtgttgaaattatttgaaaagaagccatatttggaggtattggagttttcctctttctgagacaatccactatttgaaaattgtagctactgaattgcctctcagtatgcgagctgatcactttgccttagggccactagatttctgtctcccttagcccctcaagcccttttgatcatgagttccaaaccaaaaataaataaatgaacagtgaggcagtcccttgcagtaccactgtcatgggtcaggctaagcctcctgcttttctgaattagtcaagaaaagccttggtttccctttttccatctctttatcttgtctttcagatactggccagagcctggacactcttcctctgagatctccagcttctctgccttcttgtgtttcttttaaactctaacaaaaactgttctcaccttcaaaaaataaaataataacaagctttccacatccccaccaaagagggacccagctaggtttctggaaacccagcaccagcctccagctgcccttctgcagtgtttctgcctctgtttccctttcgttttgacttttttccttcttttgagacagagttccagcatggagcctgtgcaggtttcaatcccacagtaacaccttctgcagcaccccacctgctcagactgcagccctggccaccaggcctggctacctggacattctgtctgccctgcactctcaggaaaccttggcctctgctactgtctgtttggctcattcaaagtgtgtccttaaaggaatgcagtcacccatgccagaggcagtgtttacagcctggaatgctctgcacttccagtggaccagtgctccaccggaagtgggctgttagcagggtcctctcacctggccctggcctttctgtagccttgaatcctgccttccccaccagggcaccagggatgagtgcagcagcaggaggagaggcaaacagtcacctcaggaaccttctgagctaaggcacaccctctgtgcctgtcaagcaaaggttgtattggatatcaagtgtttggtctcacgccaagccaacaggctttggagagaattaattagttctcctactcagggatttctttcagtcctaacacagcctgtgtatattttgcttcacccacgcaatgctggattatttaattttgcccggcttaagacaaatctgagttacttgtaaatttgctctatgttcataataaaaatgtattatatatcactgatagca

SEQ ID NO: 92 - protein, 521 aa, Mus musculus
MELASAHLHKGQVPWGGLLLTASLLASWSPATTAEVTIEAVPPQVAEDNNVLLLVHNLPLALGAFAWYKGNTTAIDKEIARFVPNSNMNFTGQAYSGREIIYSNGSLLFQMITMKDMGVYTLDMTDENYRRTQATVRFHVHPILLKPNITSNNSNPVEGDDSVSLTCDSYTDPDNINYLWSRNGESLSEGDRLKLSEGNRTLTLLNVTRNDTGPYVCETRNPVSVNRSDPFSLNIIYGPDTPIISPSDIYLHPGSNLNLSCHAASNPPAQYFWLINEKPHASSQELFIPNITTNNSGTYTCFVNNSVTGLSRTTVKNITVLEPVTQPFLQVTNTTVKELDSVTLTCLSNDIGANIQWLFNSQSLQLTERMTLSQNNSILRIDPIKREDAGEYQCEISNPVSVRRSNSIKLDIIFDPTQGGLSDGAIAGIVIGVVAGVALIAGLAYFLYSRKSGGGSDQRDLTEHKPSASNHNLAPSDNSPNKVDDVAYTVLNFNSQQPNRPTSAPSSPRATETVYSEVKKK

SEQ ID NO: 93 - DNA, 3388 bp, Homo sapiens
attcctcacgatgacccgacagtctctgctttctttttcctttcttccagaaggagatttaaccatagtagaaagaatggagaactattaactgcctttcttctgtgggctgtgattttcagaggggaatgctaagaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacgcactgaagcactttactgatactcattcaattattcatatgacagttgtttgagtttggtaccatcttattttccccttatacagataaggaaactggggtgcagaaaagtgaattgactacaaagtagacatgactagttaacaacacagctgggatctaaacagcaataactaacattaatggagaacttaaaatgctctgagtgctgtgttatgagctttggtggatgtcactcctttaatcctcgcaacaccctgtcgggtagtctcatttagcaagtatggaagttgaggcagggcaacattaagcaacttacataactcatgcagtaatttctgcagttgggagatgttcagcttcagtccccggccctatggccgttcttttccaccctgtttcttcccccataggaagaacccacctgtagccctgaggttcttttcccaggatggctccaggataaggatcactgtaggtggttgtggagttgacacccctgttgactccttcccagctgattgtcagagccttagacccagcacgccttggattagctctgcagagtgtcttggttgagagaataacctcaccgtacccacatgacacgtgatttggaaagagactagaggccacacttgataaatcatggggaacagatgtgttccacccaacaaatgtgataagtgatcatgcagccagagccagccttccttcaatcaaggtttccaggcagagcaaataccctagagattctctgtgatataggaaatttggatgaagggagctagaagaaatacagggatttttttttttttttaagatggagtcttactctgttgctaggctggagtgcagtggtgcgatctcagctccctgcaacctccacctcctgggttcaaacaattctcctgcctcagcctcccgagtactgggaatataggtgcacgccaccacacccaacaaatttttgtacttttagtacagatgagggttcactatgttggccaggatggtctcgatctcttgacctcatgatccacccacctcggtctcccaaagtgctgggattacaggcttgagccaccgggtgaccggcttacagggatatttttaatcccgttatggactctgtctccaggagaggggtctatccacccctgctcattggtggatgttaaaccaatattcctttcaactgctgcctgctagggaaaaactactcctcattatcatcattattattgctctccactgtatcccctctacctggcatgtgcttgtcaagttctagttgttcaataaatttgttaataatgctga

SEQ ID NO: 94 - protein, 513 aa, Homo sapiens
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 95 - DNA, 3776 bp, Homo sapiens
gactcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctga

SEQ ID NO: 96 - protein, 334 aa, Homo sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTRGEESSSDTNKSA

SEQ ID NO: 97 - DNA, 2890 bp, Homo sapiens
agatttcgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaaggcctcctgtccctgcctgctctgggtgctcatggaatcagctgctgccctgcacttctcccggccagcctccctcctcctcctcctcctcagcctgtgtgcactggtctcagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagagaaacttcaagaagaattgcgatggagaagaacattcttacatgctgttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtg

SEQ ID NO: 98 - protein, 527 aa, Homo sapiens
MESAAALHFSRPASLLLLLLSLCALVSAQFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAGLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPCAVALPIIVVILMIPIAVCIYWINKLQKEKKILSGEKEFERETREIALKELEKERVQKEEELQVKEKLQEELRWRRTFLHAVDVVLDPDTAHPDLFLSEDRRSVRRCPFRHLGESVPDNPERFDSQPCVLGRESFASGKHYWEVEVENVIEWTVGVCRDSVERKGEVLLIPQNGFWTLEMHKGQYRAVSSPDRILPLKESLCRVGVFLDYEAGDVSFYNMRDRSHIYTCPRSAFSVPVRPFFRLGCEDSPIFICPALTGANGVTVPEEGLTLHRVGTHQSL

SEQ ID NO: 99 - DNA, 2017 bp, Homo sapiens
agaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaa

SEQ ID NO: 100 - protein, 500 aa, Homo sapiens
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 101 - DNA, 3583 bp, Homo sapiens
gggactttttggacacccagagaacaggtcccagataccgagtccgcaactccaaacatcgcgattaataggaggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcgcacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctggccatctcagcagccaccgcacaacccccctaatgaaagacacgccctcctcccctctggtcacgtaagagaacatcttccagctgcctttttcacacccactccagccctctgccccagttttctcctcctcactagtctgtggctttagtagttcctttgcttgtaattatgggatgggatccaggcatagggaactagttgtttcatagctcccagtcaaaaagaaagtgagagaagctgttgggcagcgaacctactgtttaaaatcaggataaccacattaagcccaatatgccagttggcaccagatgctgtggacttggaatgaggccaacagggttcaccaggatgagagaggagagaggaatccacaggaccaccagaagggagagggaaccagatatgcagatcagagatagaggaagtggaaccagagagctgggagggaccaaggttgtaaggatggctaagtcccaccataagagctaaagggtcctgggagatgatggctcatttccacccaaccccaggatttccacagcacacacccacaggcctggacctgggatgaagatgaatgaagaacatggactcatgtggatgtggtttggctcagatgtccctgcaataaacaaggggtcagtacttagtccctgagtgtggttgaggtttgaggtcctggtcgagcagggcagtactggaccaggtctacgtcagcattcaggttcaatggggacaccagtggcttcaaacttcctgatctaattatgtttttagacacttagaagttattgaggactttaaagagcttttgtttatttgggttaatatttatgacatttgacattgaaacaaaaatttaaaatgttatcttttaatttatgttaaaatagcattaataaatcagttataggttaatgtagataggatgttttgtgaaaaagcaatctattgtgtccaaataaaaaaacaaaaagtgtgacactggttaactttttccagatctcatgtctggcttaataagagatatttgtattatcatatctgcctttgtattaaacctattggtatatcataggtcatgttagctcaaaaaaactttactgcacactactgagagaatgagatgaaaaacgattaatgtttcattattattattgtgaaaatattattaacactggggactccttaagagtacatcagagttctctctaggaatcccaaaaccacattttgaaactagaatagtggatcctggaagttaatccatgtgctggttaattttagatgtcaacctgactggattaaggaatacctagacagctggtacaacattatttctgggtgtgtctgtgagtgtgtttccagaagagattggcaagtgagtcagtgggaaattctctccttctgttggctgggtgcccaatacaacaaaaaggcagaggaaaggcaaattcttctctcctctggagctgagacactcttcttcttctgcccttggacatcagaactcctggctctccggcctttgaacttcaggacttgtaccaggaggccctgggttctcaggcctttggctttggactgagagttacacaatcagcttccctggttctgaggctttcagacttaaactgagccatgctaccagcatcccagggtctccagcctacagatgagctgttgtgcgatttcttagcctccataatcacatgagccaatctccttaataaatgcctgctcatagatctgtatctacatctatatctgtatgtgcatctatatctatgcctatatctatatctatatcatattgattttgtctctctggagaaccctgactaataaaatgaggcatctaaaa

SEQ ID NO: 102 - protein, 523 aa, Homo sapiens
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRRTFLHAADVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKESLCRVGVFLDYEAGDVSFYNMRDRSHIYTCPRSAFTVPVRPFFRLGSDDSPIFICPALTGASGVMVPEEGLKLHRVGTHQSL

SEQ ID NO: 103 - DNA, 2983 bp, Mus musculus
gaaattgtgagacttgcacgcggaatgggtcctccgaggtctgctgtcgcgagtcccagcactttgcaagtaatggagaacagaaaattctttcctctctactgtagcagtttgttctctggtggcgactgtgctcagcgacaagttggagagtagagaaaaggcaagataatcagcatttgagggtcagagaagaaaagaaaacgcagttaattctagaaggttttctgtccacacgtgacctaggtgactctgtcctgaagacctatggagcctacaacttccctgcgttcttgcccgatagcctcccttctcttcttcttggtcctcagcctgtttgtgctggtctcagcccagtttactgtcataggaccagctgagcccatcctggccatggtaggagagaataccacactacactgccacctgtcaccagagagaaatgccgaagagatggaggtgcggtggttccggtggcgtttcttccctgcagtgctggtgtacagaggccatcaagagagaccagaggagcagatggtggcataccgaggaagaaccaccttcatgcgcacagacatcagcaagggaagagttgcgctcattatccacaatgtcacagcctatgacaatggcatctactgctgttacttccaggaaggcaggtcctatgaccaggcaaccatgaagcttatggtggcaagccttggctctgagccacttattaaaatgaagacacttgaggatgggagcatcttgctagagtgcacatctgaagggtggtacccagagccccgagctgtgtggagagacccctatgatgaagttgtacctgccctggaggaggagtatacagctgacagagaaggcctcttcacagtcaccatgactataatcatcagggactgctctgtgaggaacatgacctgctctgtcaataacactctgctcagccaggaggtggaaagtgtgattctcattccagaatccttcgtgcccagccttcctctgtggatggtggctgtggctgtcactctgcctgtagtaatgctgattctcctcacatctggaagcatctgccttgtcaagaaacaccgcaggaagaaatctattctgtcagctgaaaaagaagccgaatatgaagagaaggaagctgcacggcaacttcaagaggaactgcgatggagacgaaccctcttacatgctgctgacgtggtcctggacccagatacagctcatcctgagctcttcctgtcagatgaccagagaagtgtaatacgaggctcttcgaggcagagtgtgcctgacaaccctgagagatttgactgccgtccatgtgtcctgggcagggaaagcttctcctcagggaagcattactgggaggtggaggtggaaaatgtaatggtgtgggccattggtgtttgtagagacagcgtggaaaggaaaggggaggccctgttggttcctcagaatggcttctggaccctggagatgtttggaagccagtatcgagccctgtcctccccagaaaagatcatacctctgaaagagcgtcttcaccgtatagctgtcttcctggactgtgagggtggagatatttctttctacaacatgagagacagatcacacatttacacatgtcctcctgtgactttcactgggcccctgagacccttctttaggcttggttctgatgacagtcccctgttcatctgtccagcattcacaggggcacagggagttacaatacctgagggtggcttattcctatataagacaagaccaatttctcagagccttgtaaggaagccatagctctctacacagtaccatctgttggagactagaccccatgtccttcagatcacatggagcatcttccagctgccaccttcacacatacttcaggcccagtcctcagattactacatcatttcttctaactatgggcctaggtagagccagtcttaggggactattgctgtaatacagctctctcctgagaagaaagtgtgagaagggcagaaaacttggagtttcaacatgctgctctggtcacagtggatatcaggcaagagcaacagggtggatcaggatgtaagaagtgagaactacagaggaaggagacagataaagatgaattgaggccgaagatggaggaaatggactgaagagctctggggtaagccctatgtgacagctgtggataggtaggagctaatggtccattgatatccaaagccaaagatttaaatatcacatagtgtgtctggagtgtatatctgtagacctacacatgagaggaaacaatcatagtgatgaactggatgtaagctggctcagacgtccctacaataaacacttctgagttccatgtctgtgctcagtaagaatggcttgaggcttgcggtccatgctgagcagccaggtccacatgaatcggatttactagagtaggtagcagttcaagttccttaggctcaggatgtcttcctttcccccaagcccttcccccttcaagataggtctcactatgtagaccaggccagcctccacctccagagttctgggattaaagacaagcacaaccatgtccagtttatgagcttgtgatatatacagaagattaagttctgtgttcttgggttagtaactgttgagatttgttttgagtcatgctctcactggctagcactgctcttgactttctctccccatctttttgttattgcttttcaagacatggtttcactgtgtatttctggctgataagctgattttgaattcacagagatctgcctctgcctcctgagtgctgggattaaaggtgtgttacactacgcctggcttcactctatctcttcagtgtggggattataggtttatactatcatgcctaactaatgtctgttgctgcatatgacatttgaactttagaacagaaaaacaactatacatattaatatatattaaactaataataagc

SEQ ID NO: 104 - protein, 514 aa, Mus musculus
MEPTTSLRSCPIASLLFFLVLSLFVLVSAQFTVIGPAEPILAMVGENTTLHCHLSPERNAEEMEVRWFRWRFFPAVLVYRGHQERPEEQMVAYRGRTTFMRTDISKGRVALIIHNVTAYDNGIYCCYFQEGRSYDQATMKLMVASLGSEPLIKMKTLEDGSILLECTSEGWYPEPRAVWRDPYDEVVPALEEEYTADREGLFTVTMTIIIRDCSVRNMTCSVNNTLLSQEVESVILIPESFVPSLPLWMVAVAVTLPVVMLILLTSGSICLVKKHRRKKSILSAEKEAEYEEKEAARQLQEELRWRRTLLHAADVVLDPDTAHPELFLSDDQRSVIRGSSRQSVPDNPERFDCRPCVLGRESFSSGKHYWEVEVENVMVWAIGVCRDSVERKGEALLVPQNGFWTLEMFGSQYRALSSPEKIIPLKERLHRIAVFLDCEGGDISFYNMRDRSHIYTCPPVTFTGPLRPFFRLGSDDSPLFICPAFTGAQGVTIPEGGLFLYKTRPISQSLVRKP

SEQ ID NO: 105 - DNA, 2945 bp, Homo sapiens
agctttctcacttggtagcagtggcctcttgtgcctttttctccaagatcacccaggctgaagctcctgaggggactcacatcagttatcttgctgctccagaagggtgggagatggcagttttcccaagctccggtctccccagatgtctgctcaccctcattctcctccagctgcccaaactggattcagctccctttgacgtgattggacccccggagcccatcctggccgttgtgggtgaggacgccgagctgccctgtcgcctgtctccgaacgcgagcgccgagcacttggagctacgctggttccgaaagaaggtttcgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctgctctgggctctgaccctcacatcagtatgcaagttcaagagaatggagaaatctgtctggagtgcacctcagtgggatggtacccagagccccaggtgcagtggagaacttccaagggagagaagtttccatctacatcagagtccaggaatcctgatgaagaaggtttgttcactgtggctgcttcagtgatcatcagagacacttctgcgaaaaatgtgtcctgctacatccagaatctccttcttggccaggagaagaaagtagaaatatccataccagcttcctccctcccaaggctgactccctggatagtggctgtggctgtcatcctgatggttctaggacttctcaccattgggtccatatttttcacttggagactatacaacgaaagacccagagagaggaggaatgaattcagctctaaagagagactcctggaagaactcaaatggaaaaaggctaccttgcatgcagttgatgtgactctggacccagacacagctcatccccacctctttctttatgaggattcaaaatctgttcgactggaagattcacgtcagaaactgcctgagaaaacagagagatttgactcctggccctgtgtgttgggccgtgagaccttcacctcaggaaggcattactgggaggtggaggtgggagacaggactgactgggcaatcggcgtgtgtagggagaatgtgatgaagaaaggatttgaccccatgactcctgagaatgggttctgggctgtagagttgtatggaaatgggtactgggccctcactcctctccggacccctctcccattggcagggcccccacgccgggttgggattttcctagactatgaatcaggagacatctccttctacaacatgaatgatggatctgatatctatactttctccaatgtcactttctctggccccctccggcccttcttttgcctatggtctagcggtaaaaagcccctgaccatctgcccaattgctgatgggcctgagagggtcacagtcattgctaatgcccaggacctttctaaggagatcccattgtcccccatgggggaggactctgcccctagggatgcagacactctccattctaagctaatccctacccaacccagccaaggggcaccttaaggaatatctcagctcatctgttttcctttcctctaacccctctcctccatagccttctgaggcttcacctgctagctttacccagtctgtttcttcctgttgggtggcaattaattaatcctgtgaaggttacattgctgctgctagagagggtggggattgcaccttccaaatctgtttctgtaccaatatttgggggatggaggggtgactcaaactgcttctagtgttctcctaatcccttaagactagaacctataggaaactacttggagcaaactcaaaggacagattagggatcgagattgggtcaggttagcatggggttgtggttgaaatatcttggtatccaggataagggtatgtggaaaaacaggctttaggcaagtggaaaattcaaaatgtgctgtgaaaggacaatctcaggctgaaatcccataaaggaacttggagggaatattatgatggagggaagtgaggtgaatccaggcacatgatgaacacctggctcatccatagagttttcacagcctatatcgcaaattttctaagccacgtcctataggacagaggagactggccccacttctatgggtctgagctgtggaaaagggagagcagagaggaactgagatgagcagggatgaagggtcaggcagaaagcgtgatagaggagagaatttttgacaaaactcaaaagttgtttgcacagctgttctttgtaccctgttcctttctctgcgccctcctgtttctcccttgcctggaagtcattccaccctcaatttgttgatccacaagtttccagttgtcctcttctttttgttatagcatctctctatttcaaagacattcctagaagtcatccttcagtgatatcaccacttgctcagtcaccatctcaaccttatgtcacctcagccctcatctcaatgcccaaaccccttacacacaccttcagttagcttcaactgcctccgtttccacactgtgcacctttcactttccctacccagctttcctacatgctgcctctcctcagggtcccctgaatgctgcatcattgtgttcagtgcagctggactgattgcacctgtgtatttgcccctgagcactttcctttacacatgtggcttgtcttgccaatagactccaggcttataccttccatttccatcgtattctccagtttccaggatagacgttgctcatcgtctttacctaataaataagtttgtctgattgctgaaa

SEQ ID NO: 106 - protein, 526 aa, Homo sapiens
MAVFPSSGLPRCLLTLILLQLPKLDSAPFDVIGPPEPILAVVGEDAELPCRLSPNASAEHLELRWFRKKVSPAVLVHRDGREQEAEQMPEYRGRATLVQDGIAKGRVALRIRGVRVSDDGEYTCFFREDGSYEEALVHLKVAALGSDPHISMQVQENGEICLECTSVGWYPEPQVQWRTSKGEKFPSTSESRNPDEEGLFTVAASVIIRDTSAKNVSCYIQNLLLGQEKKVEISIPASSLPRLTPWIVAVAVILMVLGLLTIGSIFFTWRLYNERPRERRNEFSSKERLLEELKWKKATLHAVDVTLDPDTAHPHLFLYEDSKSVRLEDSRQKLPEKTERFDSWPCVLGRETFTSGRHYWEVEVGDRTDWAIGVCRENVMKKGFDPMTPENGFWAVELYGNGYWALTPLRTPLPLAGPPRRVGIFLDYESGDISFYNMNDGSDIYTFSNVTFSGPLRPFFCLWSSGKKPLTICPIADGPERVTVIANAQDLSKEIPLSPMGEDSAPRDADTLHSKLIPTQPSQGAP

SEQ ID NO: 107 - DNA, 3454 bp, Mus musculus
aacagcacacagccttcttccttctgaagagctctctctttggccccggggtgacaagcagcccttttcacttgatcactgtggctctggctcccttttcctctgggtctgtcgaaatcgcctgaagctcttggcgggcttcattgccccagttagctcagagatggcagttcccaccaactcctgcctcctggtctgtctgctcaccctcactgtcctacagctgcccacgctggattcggcagctcccttcgatgtgaccgcacctcaggagccagtgttggccctagtgggctcagatgccgagctgacctgtggcttttccccaaacgcgagctcagaatacatggagctgctgtggtttcgacagacgaggtcgacagcggtacttctataccgggatggccaggagcaggagggccagcagatgacggagtaccgcgggagggcgacgctggcgacagccgggcttctagacggccgcgctactctgctgatccgagatgtcagggtctcagaccagggggagtaccggtgccttttcaaagacaacgacgacttcgaggaggccgccgtatacctcaaagtggctgctgtgggttcagatcctcaaatcagtatgacggttcaagagaatggagaaatggagctggagtgcacctcctctggatggtacccagagcctcaggtgcagtggagaacaggcaacagagagatgctaccatccacgtcagagtccaagaagcataatgaggaaggcctgttcactgtggcagtttcaatgatgatcagagacagctccataaagaacatgtcctgctgcatccagaatatcctccttggccaggggaaggaagtagagatctccttaccagctcccttcgtgccaaggctgactccctggatagtagctgtggctatcatcttactggccttaggatttctcaccattgggtccatatttttcacttggaaactatacaaggaaagatccagtctgcggaagaaggaatttggctctaaagagagacttctggaagaactcagatgcaaaaagactgtactgcatgaagttgacgtgactctggatccagacacagcccacccccacctcttcctgtatgaagattcaaagtcagttcgattggaagattcacgtcagatcctgcctgatagaccagagagatttgactcctggccctgtgtgttgggccgtgagacctttacttcagggagacattactgggaggtggaggtgggagatagaactgactgggccattggtgtgtgtagggagaatgtggtgaagaaagggtttgaccccatgactcctgataatgggttctgggctgtggagttgtatggaaatgggtactgggccctcaccccactcaggacctctctccgattagcagggccccctcgcagagttggggtttttctggactatgacgcaggagacatttccttctacaacatgagtaacggatctcttatctatactttccctagcatctctttctctggccccctccgtcccttcttttgtctgtggtcctgtggtaaaaagcccctgaccatctgttcaactgccaatgggcctgagaaagtcacagtcattgctaatgtccaggacgacattcccttgtccccgctgggggaaggctgtacttctggagacaaagacactctccattctaaactgatcccgttctcacctagccaagcggcaccataacaaatattccagcttcacgactttgccttcctttgactaatccctcatgccccgaagcttcagctgttggcttcttgcagccctgcttcttcctggtggatggagattaattcacattgggaaggttaggtatgttgctgccagacaaggcaggaagaaaggccatcctagtttgtttctgtactaacagtggggaggaagagagctgaatcctaaactatttccagtgctcatattccttcaggccagagcctatagagaaggatttggtacaatcactcgagggatcaagaggcaattaggttggcatggaattatggcagaaacatctggaataggggtatgtggaatgacaggttttaggtaagggagaacaaaaccaaaccataggatgctgagaaagaaagatcttggactaaactcctaaaaaagcacttagagaagatatgacaggcaaatgaagtgaatttggtctaatttgatacacttgccctgtccctagggtttttcagttatatctcaatttttttgttgttaattacatttttgacagcttcatacatgtatataatgcattctaattactctcactctcctctattctgtcttatttccctcccctcccctcataccttccttcttgcttcaaacctggcacactgagtttaatgggctatcatgggaacatggatttagagctttcctctgagctcaagagagcaggtgtgactgaatacagtgatttcccctctcctacaatcaatcagcagtcaatagctcagctgggaggggtagggcctcatgagacttcccctatcaaggctaaatgttgaaagggccagtttttagcacctgtgagatcatgattgcaagagcccagaagacagcattgctcggtcattctccctaccctttggcttttctggtcttttgtcctctctttcaggatgtgtctgaactctgtatcttaagttttctatgtcatgttctataagatagaggagactggccctgcttgtttgagagcaatgtgagcaagctagcaagagacagaaaggagcggagatgaataggggtagagaaaatttttaaacaaaccctccaggtgtgtgtgtgtgtgtgtgtgtcttcctcttttttgacctccctaaaggtcaatccaacctcacattattgactccactaggtgggggttctgtgtgtgtgtgtgtgtgtgtgtgtgtgtgtgtgtgtgttttaagatagaggtttactatgtagcttaggctggctttgaattcctgatcctcctgcctctaccttccaagtgctggaaacatagccacatccaccacccctatccagtccacctggtttgattcagcaacgctcaggtagcatcgctgtttgatctggagctgccagctccctcggcccccactgcaatgcttaaccccctcacaggcaccttcccttgcctaacactgccatccttttccacactgagccatttgctcaatgtagcctacccaggtatcctgctttctggtccccaaagttacaccatgatgctcagcacagctggacagtttgtcccaatttgtgtgtgtcctcctgtttgtatgggacttctttttgtcaatggcctgtgtgtgtatccaagctcttccacttctattgtatttttccggcttctaaaacagatgttaccaaataaagaaagagaaagaaaaaaaa

SEQ ID NO: 108 - protein, 524 aa, Mus musculus
MAVPTNSCLLVCLLTLTVLQLPTLDSAAPFDVTAPQEPVLALVGSDAELTCGFSPNASSEYMELLWFRQTRSTAVLLYRDGQEQEGQQMTEYRGRATLATAGLLDGRATLLIRDVRVSDQGEYRCLFKDNDDFEEAAVYLKVAAVGSDPQISMTVQENGEMELECTSSGWYPEPQVQWRTGNREMLPSTSESKKHNEEGLFTVAVSMMIRDSSIKNMSCCIQNILLGQGKEVEISLPAPFVPRLTPWIVAVAIILLALGFLTIGSIFFTWKLYKERSSLRKKEFGSKERLLEELRCKKTVLHEVDVTLDPDTAHPHLFLYEDSKSVRLEDSRQILPDRPERFDSWPCVLGRETFTSGRHYWEVEVGDRTDWAIGVCRENVVKKGFDPMTPDNGFWAVELYGNGYWALTPLRTSLRLAGPPRRVGVFLDYDAGDISFYNMSNGSLIYTFPSISFSGPLRPFFCLWSCGKKPLTICSTANGPEKVTVIANVQDDIPLSPLGEGCTSGDKDTLHSKLIPFSPSQAAP

SEQ ID NO: 109 - DNA, 2926 bp, Homo sapiens
acatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctggcagtttgagcagatcctatgtctctgagagacacattcctcataatggccagcattttgggctacaaggttttgtggttgatgatgaggatggcatgactgcagagccatcctcatctcattttttcacgtcattttcagtaactttcactcattcaaaggcaggttataagtaagtcctggtagcagcctctatggggagatttgagagtgactaaatcttggtatctgccctcaagaacttacagttaaatggggagacaatgttgtcatgaaaaggtattatagtaaggagagaaggagacatacacaggccttcaggaagagacgacagtttggggtgaggtagttggcataggcttatctgtgatgaagtggcctgggagcaccaaggggatgttgaggctagtctgggaggagcaggagttttgtctagggaacttgtaggaaattcttggagctgaaagtcccacaaagaaggccctggcaccaagggagtcagcaaacttcagattttattctctgggcaggcatttcaagtttccttttgctgtgacatactcatccattagacagcctgatacaggcctgtagcctcttccggccgtgtgtgctggggaagccccaggaaacgcacatgcccacacagggagccaagtcgtagcatttgggccttgatctaccttttctgcatcaatacactcttgagcctttgaaaaaagaacgtttcccactaaaaagaaaatgtggatttttaaaatagggactcttcctaggggaaaaaggggggctgggagtgatagagggtttaaaaaataaacaccttcaaactaacttcttcgaacccttttattcactccctgacgactttgtgctggggttggggtaactgaaccgcttatttctgtttaattgcattcaggctggatcttagaagacttttatccttccaccatctctctcagaggaatgagcggggaggttggatttactggtgactgattttctttcatgggccaaggaactgaaagagaatgtgaagcaaggttgtgtcttgcgcatggttaaaaataaagcattgtcctgcttcctaagacttagactggggttgacaattgttttagcaacaagacaattcaactatttctcctaggatttttattattattattttttcacttttctaccaaatgggttacataggaagaatgaactgaaatctgtccagagctccaagtcctttggaagaaagattagatgaacgtaaaaatgttgttgtttgctgtggcagtttacagcatttttcttgcaaaattagtgcaaatctgttggaaatagaacacaattcacaaattggaagtgaactaaaatgtaatgacgaaaagggagtagtgttttgatttggaggaggtgtatattcggcagaggttggactgagagttgggtgttatttaacataattatggtaattgggaaacatttataaacactattgggatggtgataaaatacaaaagggcctatagatgttagaaatgggtcaggttactgaaatgggattcaatttgaaaaaaatttttttaaatagaactcactgaactagattctcctctgagaaccagagaagaccatttcatagttggattcctggagacatgcgctatccaccacgtagccactttccacatgtggccatcaaccacttaagatggggttagtttaaatcaagatgtgctgttataattggtataagcataaaatcacactagattctggagatttaatatgaataataagaatactatttcagtagttttggtatattgtgtgtcaaaaatgataatattttggatgtattgggtgaaataaaatattaacatta

SEQ ID NO: 110 - protein, 244 aa, Homo sapiens
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 111 - DNA, 726 bp, Mus musculus
atgcatggctggctgctcctggtctgggtccaggggctgatacaggctgccttcctcgctacaggagccacagcaggcacgatagatacaaagaggaacatctctgcagaggaaggtggctctgtcatcttacagtgtcacttctcctctgacacagctgaagtgacccaagtcgactggaagcagcaggaccagcttctggccatttatagtgttgacctggggtggcatgtcgcttcagtcttcagtgatcgggtggtcccaggccccagcctaggcctcaccttccagtctctgacaatgaatgacacgggagagtacttctgtacctatcatacgtatcctggtgggatttacaaggggagaatattcctgaaggtccaagaaagctcagtggctcagttccagactgccccgcttggaggaaccatggctgctgtgctgggactcatttgcttaatggtcacaggagtgactgtactggctagaaagaagtctattagaatgcattctatagaaagtggccttgggagaacagaagcggagccacaggaatggaacctgaggagtctctcatcccctggaagccctgtccagacacaaactgcccctgctggtccctgtggagagcaggcagaagatgactatgctgacccacaggaatactttaatgtcctgagctacagaagcctagagagcttcattgctgtatcgaagactggctaa

SEQ ID NO: 112 - protein, 241 aa, Mus musculus
MHGWLLLVWVQGLIQAAFLATGATAGTIDTKRNISAEEGGSVILQCHFSSDTAEVTQVDWKQQDQLLAIYSVDLGWHVASVFSDRVVPGPSLGLTFQSLTMNDTGEYFCTYHTYPGGIYKGRIFLKVQESSVAQFQTAPLGGTMAAVLGLICLMVTGVTVLARKKSIRMHSIESGLGRTEAEPQEWNLRSLSSPGSPVQTQTAPAGPCGEQAEDDYADPQEYFNVLSYRSLESFIAVSKTG

SEQ ID NO: 113 - DNA, 911 bp, Homo sapiens
agagaggggcaggctggtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggggtagtggtggcaggacaagagaaggcattgagctttttctttcattttcctattaaaaaatacaaaaatca

SEQ ID NO: 114 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 115 - DNA, 842 bp, Mus musculus
gaaggtgccaaaagctccaggggatttccctgccctccgagaagaggcccagttcttcccctgcatcggacatccccgaggttctaagggcaggtcaaggcaggcagaagcttcaaaagctcggctgaggaggctacagcttcccgctgccttcaggccgctgcttccgtgcagggatgccggaggaaggtcgcccttgcccctgggttcgctggagcgggaccgcgttccagcgccaatggccatggctgctgctggtggtgtttattactgtgttttgctgttggtttcattgtagcggactactcagtaagcagcaacagaggctgctggagcaccctgagccgcacacagctgagttacagctgaatctcacagttcctcggaaggaccccacactgcgctggggagcaggcccagccttgggaaggtccttcacacacggaccagagctggaggagggccatctgcgtatccatcaagatggcctctacaggctgcatatccaggtgacactggccaactgctcttccccaggcagcaccctgcagcacagggccaccctggctgtgggcatctgctcccccgctgcgcacggcatcagcttgctgcgtgggcgctttggacaggactgtacagtggcattacagcgcctgacatacctggtccacggagatgtcctctgtaccaacctcaccctgcctctgctgccgtcccgcaacgctgatgagaccttctttggagttcagtggatatgcccttgaccacaactccaggatgacttgtgaatattttttttcttttcaagttctacgtatttataaatgtatatagtacacata

SEQ ID NO: 116 - protein, 195 aa, Mus musculus
MPEEGRPCPWVRWSGTAFQRQWPWLLLVVFITVFCCWFHCSGLLSKQQQRLLEHPEPHTAELQLNLTVPRKDPTLRWGAGPALGRSFTHGPELEEGHLRIHQDGLYRLHIQVTLANCSSPGSTLQHRATLAVGICSPAAHGISLLRGRFGQDCTVALQRLTYLVHGDVLCTNLTLPLLPSRNADETFFGVQWICP

SEQ ID NO: 117 - DNA, 3779 bp, Homo sapiens
gtcattttcctacgcgccctctgacatcagccaccttctctgtagctagtttctctgcacacaacttaatccctggcaatgaaaaatgaacctctcccccacccttgctgccgcctctcgcctcacgcccccagagaagagtttctccaccaggcagcaggtgaaggtttttttccaagtcacatgattcaggattcagggggagaatccttcttggaacagagatgggcccagaactgaatcagatgaagagagataaggtgtgatgtggggaagactatataaagaatggacccagggctgcagcaagcactcaacggaatggcccctcctggagacacagccatgcatgtgccggcgggctccgtggccagccacctggggaccacgagccgcagctatttctatttgaccacagccactctggctctgtgccttgtcttcacggtggccactattatggtgttggtcgttcagaggacggactccattcccaactcacctgacaacgtccccctcaaaggaggaaattgctcagaagacctcttatgtatcctgaaaagggctccattcaagaagtcatgggcctacctccaagtggcaaagcatctaaacaaaaccaagttgtcttggaacaaagatggcattctccatggagtcagatatcaggatgggaatctggtgatccaattccctggtttgtacttcatcatttgccaactgcagtttcttgtacaatgcccaaataattctgtcgatctgaagttggagcttctcatcaacaagcatatcaaaaaacaggccctggtgacagtgtgtgagtctggaatgcaaacgaaacacgtataccagaatctctctcaattcttgctggattacctgcaggtcaacaccaccatatcagtcaatgtggatacattccagtacatagatacaagcacctttcctcttgagaatgtgttgtccatcttcttatacagtaattcagactgaacagtttctcttggccttcaggaagaaagcgcctctctaccatacagtatttcatccctccaaacacttgggcaaaaagaaaactttagaccaagacaaactacacagggtattaaatagtatacttctccttctgtctcttggaaagatacagctccagggttaaaaagagagtttttagtgaagtatctttcagatagcaggcagggaagcaatgtagtgtggtgggcagagccccacacagaatcagaagggatgaatggatgtcccagcccaacctctaattcactgtatggtcttgatctatttcttctgttttgagagcctccagttaaaatggggctccagtaccagagcagctagcaactctgccctaatgggaaatgaaggggagctgggtgtgagtgtttacactgtgcccttcacgggatacttcttttatctgcagatggcctaatacttagttgtccaagtcgcgatcaaggactctctcacacaggaaacttccctatactggcagatacacttgtgactgaaccatgcccagtttatgcctgtctgactgtcactctggcactaggaggctgatcttgtactccatatgaccccacccctaggaacccccagggaaaaccaggctgggacagccccctgttcctgagatggaaagcacaaatttaatacaccaccacaatggaaaacaagttcaaagacttttacttacagatcctggacagaaagggcataatgagtctgaagggcagtcctccttctctaggttacatgaggcaggaataagaagtcagacagagacagcaagacagttaacaatgtaggtaaagaaatagggtgtggtcactctcaattcactggcaaatgcctgaatggtctgtctgaaggaagcaacagagaagtggggaatccagtctgctaggcaggaaagatgcctctaagttcttgtctctggccagaggtgtggtatagaaccagaaacccatatcaagggtgactaagcccggcttctggtatgagaaattaaacttgtatacaaaatggttgccaaggcaacataaaattataagaattcactataccttcccctccctggaactcaggatccaagtctagaaaatgaaaggactgggtttgaattgcttcaaaacctcttccatctcagaagaccagaccctgggaactgagattccagacacaattttggaagctctccaaccaaaataaggcccccctaccccagtatataattgaagacactagtaacacctgactgcatctcatctcagcagagccagaatatggggacaaggttcagggtgccctgctgaatggtgtgaacagcaggatctcaaggatgtaatggaaagaactaccacactgaccatccagaatctaagagaccatctgggtgtttgggaaaccatctgacgaggcctgactctattccagttagattgacaataattgagcagcaggcatttttcatttctggtcaggaaagcattgtgcctttagcaaacaatcagtgtgcaacagtgatgtggtcatctagccagggaatggctgctccatcccctgcataatatattcctgcttcaaacacctctcagaaaaccagttccgcgagggtttttatatccccacaaagttgttgagagacaatgatgaccctggaagtggggaggaggacttctgagaaacagcaacctctctcctgattggggtagccatgagatttctctagctatatccaacttggcatctgtacatcatctttggaggaacatcttatttgtggaaggaccttgacaagccgtttgagatggaatgtaggccctgatgttatgcttcagtaaaaaaagatggaagcttccctgctataccaaaacatggagcaaaatttgcatttttctcaagaaggagagaaaaggagtaggactccagcaaagtttgtcagaaggaaagctagaaaagatttaaaagaaaaaaagaaagaacaaatcagcagtggtggtatggatgaaagggacttgagagaacaaaaatggctaagggaaaattttaagtcatctgctgagcagtgtgctgtgtcaacctcctcctaggtctcctctatgaaatatttagtaaagtctacatttctctttaactctttctgtgagtagattctttgggagaagcaggcattggaagaggtgttgaattcagcaagccaaatggtctgtggtaaaaaacaaaacagactttgagactcaaggctaaaaaaacagggaaatggctggcatttgagtcacacactaactgcataggacaaatgaatcttgcttaaaccaactcatgcattcttgaaaaggtatatgcaacccaactgtgtgttaactaagcaatttttttgccatctcacattctaactcgagaaagattccattttcatttttcaccaactgttctctgagcagaggtacctgacttttgcactgtgagtggtttctaatctcagtctctgtcaagcaatgctaagaaagccaacacctaaagacacaaggggtacatcatttaaatgaataatgtaaccaaacaaacaaaaaaagagaataatcattaataactcaactgatagatatgtagggagtaggcaacccaggaagtttaaaactaaattctgttactcttgagggttaaccagcccctgggaatgttatgagcaaatgatactccatgagtaaaatgatatctatgcaagtaaaataaataatttatctaactgggaa

SEQ ID NO: 118 - protein, 234 aa, Homo sapiens
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 119 - DNA, 2228 bp, Mus musculus
agattaatcccaggcgatgaaaaatgaacctctcccccacccttgcagccacccttcgcctcacgcccccagagaagagtttctccatccggcaactggtgaaggcttttttccaagtcacatgatccaggatgcaggggaaaatccttcttggaacagagctgggtacagaaccgaatcagatgaggagagataaggtgtgatgtgggacagactatataaagcatggagccagggctgcaacaagcaggcagctgtggggctccttcccctgacccagccatgcaggtgcagcccggctcggtagccagcccctggagaagcacgaggccctggagaagcacaagtcgcagctacttctacctcagcaccaccgcactggtgtgccttgttgtggcagtggcgatcattctggtactggtagtccagaaaaaggactccactccaaatacaactgagaaggccccccttaaaggaggaaattgctcagaggatctcttctgtaccctgaaaagtactccatccaagaagtcatgggcctacctccaagtgtcaaagcatctcaacaataccaaactgtcatggaacgaagatggcaccatccacggactcatataccaggacgggaacctgatagtccaattccctggcttgtacttcatcgtttgccaactgcagttcctcgtgcagtgctcaaatcattctgtggacctgacattgcagctcctcatcaattccaagatcaaaaagcagacgttggtaacagtgtgtgagtctggagttcagagtaagaacatctaccagaatctctctcagtttttgctgcattacttacaggtcaactctaccatatcagtcagggtggataatttccagtatgtggatacaaacactttccctcttgataatgtgctatccgtcttcttatatagtagctcagactgaatagttgttcttaacctttatgaaaatgctgtctaccatacagtacttcatctgtccaaacatgggccaaagaaaatattaggacaactcaaactaagcatgtgagttagtgcacttctctttctgtcctttggaaaaatacaaacccaggatttagaaagtggagtctccttcagatgcacaaacaggaaagaatgtgatatgtgcacagagacctacttgggcactagaaggggttgagttgtcccagtataaccactaattcactgaccttgagccatttttccttcccctggaacttggggtctgaatctggaaaagtaggagatgagatttacatttccccaatattttcttcaactcagaagacgagactgtggagctgagctccctacacagatgaaggcctcccatggcatgaggaaaatgatggtaccagtaatgtctgtctgactgtcatctcagcaagtcctaaggacttccatgctgccttgttgaaagatactctaacctcttgtaatgggcaaagtgatcctgtctctcactgaggggagtagctgctgccatctcctgagacatacatggagacattttctgcccaaattccattctgtgtgcagtttttaagtattcccccaaaagttcttgacaatgagaactttgaatgtgggaagagcttctggacagcaaacattaacagcttctcctgaccagagagaccatgcaagcttggtcttagacccatcaagcttgaggtttctacattgtgggagacagacttttgacaaaccatttgagttgatgtctgggcccctgggagttctccttcagtaaggagagcaagccgttctagtgctgtgtcagaggatggagtaaaatagacacttttctgaaggaaaggagaacaaagttccagaaaaaggctagaaaatgtttaaaaggaaaagaaaaaactcagcttttctcatatgagaggaacccagaaaaacaacactgaaaaagaagagtggctctgtcaacctcctcttaggtctcctcctctctagttattgggaaaggagttgcatggtacaggacaagttctggtgtgtggtcaaatagaatcagatgtggagaacaccatgcagagaataaggagacctgtcatatttgtgttgtactcaaatgaggggcaaatgaatcttaggctaaatcaaataacagtctctgtcaagctgtgctcagaaagtcaaccactgaagatggagggtgaggcacgtcatttaaaaaaagtgaaatgtagc

SEQ ID NO: 120 - protein, 239 aa, Mus musculus
MEPGLQQAGSCGAPSPDPAMQVQPGSVASPWRSTRPWRSTSRSYFYLSTTALVCLVVAVAIILVLVVQKKDSTPNTTEKAPLKGGNCSEDLFCTLKSTPSKKSWAYLQVSKHLNNTKLSWNEDGTIHGLIYQDGNLIVQFPGLYFIVCQLQFLVQCSNHSVDLTLQLLINSKIKKQTLVTVCESGVQSKNIYQNLSQFLLHYLQVNSTISVRVDNFQYVDTNTFPLDNVLSVFLYSSSD

SEQ ID NO: 121 - DNA, 2744 bp, Homo sapiens
atcacttgtgaatttttgttttccacagctctcatttctccaaaaatgtgtttgagccacttggaaaatatgcctttaagccattcaagaactcaaggagctcagagatcatcctggaagctgtggctcttttgctcaatagttatgttgctatttctttgctccttcagttggctaatctttatttttctccaattagagactgctaaggagccctgtatggctaagtttggaccattaccctcaaaatggcaaatggcatcttctgaacctccttgcgtgaataaggtgtctgactggaagctggagatacttcagaatggcttatatttaatttatggccaagtggctcccaatgcaaactacaatgatgtagctccttttgaggtgcggctgtataaaaacaaagacatgatacaaactctaacaaacaaatctaaaatccaaaatgtaggagggacttatgaattgcatgttggggacaccatagacttgatattcaactctgagcatcaggttctaaaaaataatacatactggggtatcattttactagcaaatccccaattcatctcctagagacttgatttgatctcctcattcccttcagcacatgtagaggtgccagtgggtggattggagggagaagatattcaatttctagagtttgtctgtctacaaaaatcaacacaaacagaactcctctgcacgtgaattttcatctatcatgcctatctgaaagagactcaggggaagagccaaagacttttggttggatctgcagagatacttcattaatccatgataaaacaaatatggatgacagaggacatgtgcttttcaaagaatctttatctaattcttgaattcatgagtggaaaaatggagttctattcccatggaagatttacctggtatgcaaaaaggatctggggcagtagcctggctttgttctcatattcttgggctgctgtaattcattcttctcatactcccatcttctgagaccctcccaataaaaagtagactgataggatggccacagatatgcctaccataccctactttagatatggtggtgttagaagataaagaacaatctgagaactattggaatagaggtacaagtggcataaaatggaatgtacgctatctggaaatttctcttggttttatcttcctcaggatgcagggtgctttaaaaagccttatcaaaggagtcattccgaaccctcacgtagagctttgtgagaccttactgttggtgtgtgtgtctaaacattgctaattgtaaagaaagagtaaccattagtaatcattaggtttaaccccagaatggtattatcattactggattatgtcatgtaatgatttagtatttttagctagctttccacagtttgcaaagtgctttcgtaaaacagttagcaattctatgaagttaattgggcaggcatttgggggaaaattttagtgatgagaatgtgatagcatagcatagccaactttcctcaactcataggacaagtgactacaagaggcaatgggtagtcccctgcattgcactgtctcagctttagaattgttatttctgctatcgtgttataagactctaaaacttagcgaattcacttttcaggaagcatattcccctttagcccaaggtgagcagagtgaagctacaacagatctttcctttaccagcacactttttttttttttcctgcctgaatcagggagatccaggatgctgttcaggccttatcccaaccaaattcccctcttcactttgcagggcccatcttagtcaaatgtgctaacttctaaaataataaatagcactaattcaaaatttttggactcttaaattagctacttgcaggttcttgttgaaaggtatataatattacattgtaaacaaatttaaaatatttatggatatttgtgaaaagctgcattatgttaaataatattacatgtaaagctatttaaaagaggttttttttgtattttgtttaacaaaaattgctcaggagcatgctaagcctgaggccaagttgtttcttagtatgactttttaaaaaaacatctgctgagtagctacagggccaaagacttggagagcttgtttctgttgcatttgcatatcttctcaggaaattaaagtgtgtcatacatatgtgtgtgtgtgtgtgtgtgtgtgtgtatatgtgtgtgtgtatatatatgtatacttataaaatcttggtgttcttgatctttgttgtgttataagcaatgtgtgctggagtgggctggtgctagcttataagcacatattattaaattttcaggaatgttgcactttagttattaactataggcattcttgaaattggctatggtgggagtatttataccatgtaaattggcaaacactacacattttccttttggacagctagttcaccagcacaccactgtgaaactctccttaatgactcctctctgcccccgcttcattcctgggataatcatagcagactaagggagaaaatgaaattgtaaaaatttggcatactggtgatttctcagggcaagcagaggttactacagctgcagctagagggatgactaccaacaggtgacctttacattttcctgatgttataattttagcttttgttttcaatgtatactgttttcctgtttctccacatagtagtctgcattttaaatctataataaaacatgctgataactgg

SEQ ID NO: 122 - protein, 177 aa, Homo sapiens
MCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 123 - DNA, 2064 bp, Mus musculus
ttgtgggtatctgctttccccagttctcattccatcagagaacgagttctagcctcatggaggaaatgcctttgagagaatcaagtcctcaaagggcagagaggtgcaagaagtcatggctcttgtgcatagtggctctgttactgatgttgctctgttctttgggtacactgatctatacttcactcaagccaactgccatcgagtcctgcatggttaagtttgaactatcatcctcaaaatggcacatgacatctcccaaacctcactgtgtgaatacgacatctgatgggaagctgaagatactgcagagtggcacatatttaatctacggccaagtgattcctgtggataagaaatacataaaagacaatgcccccttcgtagtacagatatataaaaagaatgatgtcctacaaactctaatgaatgattttcaaatcttgcctataggaggggtttatgaactgcatgctggagataacatatatctgaagttcaactctaaagaccatattcagaaaactaacacatactgggggatcatcttaatgcctgatctaccattcatctcttagagattgggtttggtctcctcatcttcttctttgtatcccgagatgctggtgggtgggttggagggggatgattgatggcaatgcacacagtttgtgagggcttacaaattgacacaatcagagcctcttggcatataaaattttagccctcatatctgtctgaagaggactcagcaaatgggccaatccctaatgttgggtctgcaaatggacttgtacaatccatgataaaaaggagtatgggccacagaagacagaaactcttccaaagaatgtctttctaaccttgatccctgggtagaatgagatcctgtttccatgggagtcttacttggcttgcaaaaaagggtgtagggcagtagcttggccttttttccatcataatttccttgagctgttttaccttaatccctccaaactctcaccttctgagagcctcctaatgaaacattgttagactggtggggtggccaagacatgccaacaacacccttctttagaggtggtgtttttagaggacagagaacattatgaagcctagagcagcagaggtcaagatgccacgaaatggaattgatctgggaattttttttttttttcattctcaggatgcaggttcattctgaactttcccctaggccttcattgcttttgtgtgtatgtgtgcataaattctgcaaatagaaaaatgagagtttgcaccagtactcactagatttaacaccagaaagtggtacttttctggctgtattatgccatgatagcacattttctgttggtgttccctaactgacaagtataacagttttcctaaaccacacaacaatgctatgatgttaatggggtagatatttttggaaaaaaattgcacagtgagaacatgggtagatgaaccctaagactcttacctcaattcagaactcgcaaggagttaagtgagtggggtcttcattagaccattcacatggtctctgctttgaaactggcgttgctactgtctcattatacatcactaaaatggaattaactcaactttgaaatggatgcatcgactttaccccaaggtgtccagaatgaagctacaagacttttaccagcagtcattttccttttgcctggagcaagaagatccaggatactgttggaagagttcatctcactcaaccatgctgactttccaaagtaataatgaacatttgtgttcaaattttggattctgttaaatttagccagcttgtgagttcttgtcgaaaagtattttaaaccaatttacactatttatgggtatttgtgaaaagctatatagtgatattttatatataactaatttaaaatatttttattttatgtaacaaaaatactataggctaagctatttcttcttatttttttatgaatacttgctgaattgccatagggcacaaagactcttctgtttgcatatcttctcaggaaattaaaattgtatcacatgtatttataagaa

SEQ ID NO: 124 - protein, 173 aa, Mus musculus
MEEMPLRESSPQRAERCKKSWLLCIVALLLMLLCSLGTLIYTSLKPTAIESCMVKFELSSSKWHMTSPKPHCVNTTSDGKLKILQSGTYLIYGQVIPVDKKYIKDNAPFVVQIYKKNDVLQTLMNDFQILPIGGVYELHAGDNIYLKFNSKDHIQKTNTYWGIILMPDLPFIS

SEQ ID NO: 125 - DNA, 1852 bp, Homo sapiens
aatcctgagtaaggtggccactttgacagtcttctcatgctgcctctgccaccttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacatta

SEQ ID NO: 126 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 127 - DNA, 1250 bp, Mus musculus
ctttcagtcagcatgatagaaacatacagccaaccttcccccagatccgtggcaactggacttccagcgagcatgaagatttttatgtatttacttactgttttccttatcacccaaatgattggatctgtgctttttgctgtgtatcttcatagaagattggataaggtcgaagaggaagtaaaccttcatgaagattttgtattcataaaaaagctaaagagatgcaacaaaggagaaggatctttatccttgctgaactgtgaggagatgagaaggcaatttgaagaccttgtcaaggatataacgttaaacaaagaagagaaaaaagaaaacagctttgaaatgcaaagaggtgatgaggatcctcaaattgcagcacacgttgtaagcgaagccaacagtaatgcagcatccgttctacagtgggccaagaaaggatattataccatgaaaagcaacttggtaatgcttgaaaatgggaaacagctgacggttaaaagagaaggactctattatgtctacactcaagtcaccttctgctctaatcgggagccttcgagtcaacgcccattcatcgtcggcctctggctgaagcccagcagtggatctgagagaatcttactcaaggcggcaaatacccacagttcctcccagctttgcgagcagcagtctgttcacttgggcggagtgtttgaattacaagctggtgcttctgtgtttgtcaacgtgactgaagcaagccaagtgatccacagagttggcttctcatcttttggcttactcaaactctgaacagtgcgctgtcctaggctgcagcagggctgatgctggcagtcttccctatacagcaagtcagttaggacctgccctgtgttgaactgcctatttataaccctaggatcctcctcatggagaactatttattatgtacccccaaggcacatagagctggaataagagaattacagggcaggcaaaaatcccaagggaccctgctccctaagaacttacaatctgaaacagcaaccccactgattcagacaaccagaaaagacaaagccataatacacagatgacagagctctgatgaaacaacagataactaatgagcacagttttgttgttttatgggtgtgtcgttcaatggacagtgtacttgacttaccagggaagatgcagaagggcaactgtgagcctcagctcacaatctgttatggttgacctgggctccctgcggccctagtagg

SEQ ID NO: 128 - protein, 260 aa, Mus musculus
MIETYSQPSPRSVATGLPASMKIFMYLLTVFLITQMIGSVLFAVYLHRRLDKVEEEVNLHEDFVFIKKLKRCNKGEGSLSLLNCEEMRRQFEDLVKDITLNKEEKKENSFEMQRGDEDPQIAAHVVSEANSNAASVLQWAKKGYYTMKSNLVMLENGKQLTVKREGLYYVYTQVTFCSNREPSSQRPFIVGLWLKPSSGSERILLKAANTHSSSQLCEQQSVHLGGVFELQAGASVFVNVTEASQVIHRVGFSSFGLLKL

SEQ ID NO: 129 - DNA, 4778 bp, Homo sapiens
cgagactccatctcaaaaacaaaacaaataaacgaacaaaaaaacccacaacgtattattttcttgtttacgaggtttcttgtctctctggctccaccagaagaggagcagggacccttcttgctgttgttcattgctgcatcccccacaccgagagcagagcctggcatgggcagaaagtcctcagtcgatatttggtggccccaagcgaatgaagcatccaagaagggaaagctgggggctccccactgcacttgccacctgagtcacattttcagaagcctctggaaagtcgtgcacagcccaggagtgttgagcaatttcggtttcctctgaggttgaaggacccaggcgtgtcagccctgctccagacaccttgggcatggaggagagtgtcgtacggccctcagtgtttgtggtggatggacagaccgacatcccattcacgaggctgggacgaagccaccggagacagtcgtgcagtgtggcccgggtgggtctgggtctcttgctgttgctgatgggggccgggctggccgtccaaggctggttcctcctgcagctgcactggcgtctaggagagatggtcacccgcctgcctgacggacctgcaggctcctgggagcagctgatacaagagcgaaggtctcacgaggtcaacccagcagcgcatctcacaggggccaactccagcttgaccggcagcggggggccgctgttatgggagactcagctgggcctggccttcctgaggggcctcagctaccacgatggggcccttgtggtcaccaaagctggctactactacatctactccaaggtgcagctgggcggtgtgggctgcccgctgggcctggccagcaccatcacccacggcctctacaagcgcacaccccgctaccccgaggagctggagctgttggtcagccagcagtcaccctgcggacgggccaccagcagctcccgggtctggtgggacagcagcttcctgggtggtgtggtacacctggaggctggggagaaggtggtcgtccgtgtgctggatgaacgcctggttcgactgcgtgatggtacccggtcttacttcggggctttcatggtgtgaaggaaggagcgtggtgcattggacatgggtctgacacgtggagaactcagagggtgcctcaggggaaagaaaactcacgaagcagaggctgggcgtggtggctctcgcctgtaatcccagcactttgggaggccaaggcaggcggatcacctgaggtcaggagttcgagaccagcctggctaacatggcaaaaccccatctctactaaaaatacaaaaattagccggacgtggtggtgcctgcctgtaatccagctactcaggaggctgaggcaggataattttgcttaaacccgggaggcggaggttgcagtgagccgagatcacaccactgcactccaacctgggaaacgcagtgagactgtgcctcaaaaaaaagaaaggaagaaaaaagaaaactcaggaaacagatcttgggggacactccagggaacccaaaactcaaaggcggagagctcagtgggcaccaccaaggcgagatgaagccccagcaggcaccttcagaagacccacgtagactgcagaccctgccacggacaatactaaggacaaaaacccagagacttggggtctgtgggcccccaaacatggggtaaagttgatttgcctgatattcaggaagaaggggtgaggggtgggtatttatgcttttgattcagaagaaagtggggcttgggattccagggacttggctgggggtgggaaacttcatccacttccctactctcatcatgagtacggacagggtgggcgggagactgatcatcgggactcatcatgaagagcccagccccaccccacatactcagatcccacccacagactggtggccacacctcagcctggtcacaaagagttacactcagatacatgagcacggcagcgtgctcataactgtttaacaaccagctgtcctgggagggggacagctttgtaatgtttgccaatttccatggtgtaaatgctaccaccatggctgatttcatcactgccaagcatagacatccctaataggacaccacggatctgtccccggcatccggcccagggcctggcacaaagcatgctctagggaaatgcttgctgattgaaaggaaggaagaatgactctacagtcacacctatggcatcccacaaaatctgtcacatggctgcataatctcagccactctttcacaactatagactcatacacgcgaagtgccagattcatgcacaaccacacaatcacatggaagtcacagacggcatcacagacagtcacagcactgtgtgtatgttataacacaagcacacaaaactcagacagcatcccagctacacagccactcccagaggtgtcaccgtcacacttggtaattaatactcattacattagacacagacagaccaagttatagtcagacctggttacacacatacacacacacaatatcaccatgacaaatacacattacacacacacaacatcacaatgacaaacacacattacacacacaacatcacgatgacaaacacacattacacacacaacatcacgatgacaaacacacattacacacacatcacaatgacaaacacaacattacacacacacaacatcacaatgacacacacatcacacacacatcacaatgacaaacacacaacattacacacatatacacacagcctgagggccctccccagcccagactaacacatctcggggtgaggaccagaccttgttcataaccctgggcctcttaaccactgatctttgaaataaatggcaaatagttgtacctggatctgtctagttcttaggggaacaaactgaagaagggtggagaggaattgtcaggcctaaagagccccacagggaaagggaggagtcggatggggggcaaccatcagcaacaagtggtggctcctagaggcagagggatggaggtaatgacccatggaggtcattctacagatgaggaacctggacccagttggctcaagtccatgcaggaaatgtgggggaaaccagagacctcacgtctggatctggcttcctctccaatccacaattcctgaggaagtagaggctacatcccgcaagacgcccttattagacacatccaggacagaatgacaatccgccaagccagctggaagcataaaacacagggagctggtgggttgggtgggggcagataatgatatgcatacaaattagagggtctatgcaaatgagcattgctgcagtgtggctggagggaatccttagttcctaggattctaggatatgggtttcgaccccagaggtgaatgtattgttattattgttttgttgttgttgtgaatgacaagtcaaaatttgtgggttattgttgttatcgccaatagtattcttgtcattgttgcacagtacagagatgaaggaaacagattttgcaatcagatgatcctgggttctgagtccactctgccactcaccagctatatgacctccagcaatttccatcacctctcaatgcttcagtttccccatcggcaagatggttgtggggggagaggaacaacagtacagattcaccatcccaaattcaaaatgctccaaaatctaggccgggcgtggtggctcatacctgtaatcccagcactttgggaggtcaaagtggacggataacctgaggtcaggagctccagaccagcctggccaacatggcgaaaccccatctctactaaaaatacaaaaaattacctgggtgtggtggggggcacctgtaaccccagctactcgggaggctgaggcaggaaccctggaggttgaggttgcagtgagctgagatcacaccactgcactccagcctgggtgacagagcaaggctcccatctcaaaaaacaaaaaaacatgctccaaaatctgaaactctttgagccccagtgtgatgccacaagtgggaaattccacaactcatcacatgtgatagattgcagtggaaatgcaggcacacaccacgaagtttactcagcatcctcaaaggaaatccccgtcagtagctatatatcattttctcacatgccagataggtatctctcatcttttactgttaggtacttctgtgttgaataggtggaggaaaatgattgctggttagtagtatataaattcagagtcaggaaggatggtgatgtcggctgggtgcagtggctcatgcctgtaattccaatgtgataccctaccttgtgtttaacgtgattgactctcccttagctgagagggccaggcagactctattttggcttcttcgcttgcagtctctcacccaccccccttcctcaaggacttaagctgactcccagcacatccaagaatgcgattactgataagatactgtgacaagctatatccacaattcccaggaattcgtccggttgatagcacccaaagcccccgcgtctatcaccttgtgatagatttaaagcccctgcacctggaactgtttgtttttctgttaccatttatctttttcactttcttgcctgttttgcttctgtaaaattgcttcagctcggctccctcttccccttctaaaccaaggtataaaaagaaacctagccccttctttggggtggagagaattttgagcgctagccgtctctcagtcgccggctaataaaggactcctgaattagtctaa

SEQ ID NO: 130 - protein, 240 aa, Homo sapiens
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 131 - DNA, 1869 bp, Mus musculus
ttttgcagtttgcacagcccgagcgtgttgggcaattgtggtttcctccggagaggaggaactcaggcttgccaaccctttccctgggcttcggagcctcagctgctctggcatggagagtgtggtacagccttcagtgtttgtggtggatggacagacggacatcccattcaggcggctggaacagaaccaccggagacggcgctgtggcactgtccaggtcagcctggccctggtgctgctgctaggtgctgggctggccactcagggctggtttctcctgagactgcatcaacgtcttggagacatagtagctcatctgccagatggaggcaaaggctcctgggagaagctgatacaagatcaacgatctcaccaggccaacccagcagcacatcttacaggagccaacgccagcttgataggtattggtggacctctgttatgggagacacgacttggcctggccttcttgaggggcttgacgtatcatgatggggccctggtgaccatggagcccggttactactatgtgtactccaaagtgcagctgagcggcgtgggctgcccccaggggctggccaatggcctccccatcacccatggactatacaagcgcacatcccgctacccgaaggagttagaactgctggtcagtcggcggtcaccctgtggccgggccaacagctcccgagtctggtgggacagcagcttcctgggcggcgtggtacatctggaggctggggaagaggtggtggtccgcgtgcctggaaaccgcctggtcagaccacgtgacggcaccaggtcctatttcggagctttcatggtctgaaggctgcggtgacaatgtattttgtggagggacctctccaggactcacctcaaacccagcaatagggtttgaagtcctccctttaaggagccctgaactctgcagtgctcggggcggtgtagactgctgacctgctttgggcaatcttcaaatcagagacctggagacttggggcgtggagcccaggagcgaggggtcagctcatttgcctgatattcaggaagaaagaatcaagctggggtatttatgcttctgatgcaaacactgagatttcggctttctgggttttgagctggaggcaagaaaccttcccagagtgtcatcaggaccatgttggcaggacttggggctccagacttgccaccacactctggcctctcccatccatccgctgcattggtttccagccaccaaaacagcactggccccctggctgcaactggccaggtacgagcttctgagcacctacattcctcagggacatcttgatgagatctcagtactcagtccaatgcgcagcagcgacagacatgccaggaatggttggtcagaagggaagggaggaaagggaggaaagaagggaatgcagaagagaaggggggaaaacaagaccaaaacaaaacagcaacaacaaagcggcagggaggaggtgacacccttggggatactttagtcaacacacttagaacagattgtgccaggcctgttggattcctggagttgatgggatcgtgggaaggcacaatggggagcaagtgggcttgggttatggctcagtgggtaaagtgcaattatggggatctgagtttgaatccctggtacccatataaagacacagatgcggtgatgggcacttgtgacaatgagatcatcaatagggaatggagacaggagggacctctggggttcactggccaggcagtctagctgaatcaaagagctccaagttcagtcgatagctcctgaagatgacaactgaggctattctccaaaccccacacgcaggacacatgcgtaataaataaaattttaaaaat

SEQ ID NO: 132 - protein, 239 aa, Mus musculus
MESVVQPSVFVVDGQTDIPFRRLEQNHRRRRCGTVQVSLALVLLLGAGLATQGWFLLRLHQRLGDIVAHLPDGGKGSWEKLIQDQRSHQANPAAHLTGANASLIGIGGPLLWETRLGLAFLRGLTYHDGALVTMEPGYYYVYSKVQLSGVGCPQGLANGLPITHGLYKRTSRYPKELELLVSRRSPCGRANSSRVWWDSSFLGGVVHLEAGEEVVVRVPGNRLVRPRDGTRSYFGAFMV

SEQ ID NO: 133 - DNA, 6583 bp, Homo sapiens
agaggtgcctccaggagcagcaggagcatggccgaggatctgggactgagctttggggaaacagccagtgtggaaatgctgccagagcacggcagctgcaggcccaaggccaggagcagcagcgcacgctgggctctcacctgctgcctggtgttgctccccttccttgcaggactcaccacatacctgcttgtcagccagctccgggcccagggagaggcctgtgtgcagttccaggctctaaaaggacaggagtttgcaccttcacatcagcaagtttatgcacctcttagagcagacggagataagccaagggcacacctgacagttgtgagacaaactcccacacagcactttaaaaatcagttcccagctctgcactgggaacatgaactaggcctggccttcaccaagaaccgaatgaactataccaacaaattcctgctgatcccagagtcgggagactacttcatttactcccaggtcacattccgtgggatgacctctgagtgcagtgaaatcagacaagcaggccgaccaaacaagccagactccatcactgtggtcatcaccaaggtaacagacagctaccctgagccaacccagctcctcatggggaccaagtctgtatgcgaagtaggtagcaactggttccagcccatctacctcggagccatgttctccttgcaagaaggggacaagctaatggtgaacgtcagtgacatctctttggtggattacacaaaagaagataaaaccttctttggagccttcttactataggaggagagcaaatatcattatatgaaagtcctctgccaccgagttcctaattttctttgttcaaatgtaattataaccaggggttttcttggggccgggagtagggggcattccacagggacaacggtttagctatgaaatttggggcccaaaatttcacacttcatgtgccttactgatgagagtactaactggaaaaaggctgaagagagcaaatatattattaagatgggttggaggattggcgagtttctaaatattaagacactgatcactaaatgaatggatgatctactcgggtcaggattgaaagagaaatatttcaacaccttcctgctatacaatggtcaccagtggtccagttattgttcaatttgatcataaatttgcttcaattcaggagctttgaaggaagtccaaggaaagctctagaaaacagtataaactttcagaggcaaaatccttcaccaatttttccacatactttcatgccttgcctaaaaaaaatgaaaagagagttggtatgtctcatgaatgttcacacagaaggagttggttttcatgtcatctacagcatatgagaaaagctacctttcttttgattatgtacacagatatctaaataaggaagtatgagtttcacatgtatatcaaaaatacaacagttgcttgtattcagtagagttttcttgcccacctattttgtgctgggttctaccttaacccagaagacactatgaaaaacaagacagactccactcaaaatttatatgaacaccactagatacttcctgatcaaacatcagtcaacatactctaaagaataactccaagtcttggccaggcgcagtggctcacacctgtaatcccaacactttgggaggccaaggtgggtggatcatctaaggccgggagttcaagaccagcctgaccaacgtggagaaaccccatctctactaaaaatacaaaattagccgggcgtggtagcgcatggctgtaatcctggctactcaggaggccgaggcagaagaattgcttgaactggggaggcagaggttgcggtgagcccagatcgcgccattgcactccagcctgggtaacaagagcaaaactctgtccaaaaaaaaaaaaataaaataataactccaagcctttaaaaaatatcatctgaaactgttacatcagatttctggcactctactgactgtggaagatagccagctgactggaagatagccagctgattagttccctgaagaaacctgaagacagatacctggttaactagatcaactacactgccaacttgtttgatgctgagagacaatggacttattccatgggggaagggaaaaaagaagtcaatcaccaaatctgaagaagttaacctagatctttgaggtttgatttgcaactttatatgcagagtattatgtgggtattttcccttaaaatattcaaagggatttacatatgggattagctaatgagcctagccaagaccttccctggaggacaggctggtcattgcggaggtcccttctgtgcttcagtgggttcatatcctctagtccgtatgattttcctacgctaatatgtcaagggcaggagaggcagctctgttctcctagcctttgttgacttgtctgcaaagcaggaatctgcccatttgtttccaaggagcaaatgagctcatgagaatgaaagatgttaacttcatgcattctgtgccatctgagcatttcggtattatatgactggtgacccttggcccgtattataaatgcttcctatcctgggagacctcatggatgagtctgagaggaaatttggcaccaaaatcactctcactctggtttccagtagactatagaggcagagaggcatttgagaggctcctgagcaaagtgtccagtgtagcaggagcacttcattaatatttattgagttataattaaataaaaattaatttctgatttctcagtttggaggttaaggctctaaatatattttctaacctctgctaggctaacttaagccaggcctttttcttgccttccctttctcaaaacagtcagcacagactcagtgggagcacagaggagtgtggtcacctccacctggctcaccagagtcttcatagaggaagtgaagcctggaagaaactgggcgggccccagatgaccacagggaaagggcatctcagatggaggaattacccttgacttaaagcagaaaagaaagatttctcagtaactccaaaacttgcttgataggagaatattccctcaaccaattcctaggacaatatttattggtagatcaagaatgtttcctcaataactctagtctagctccatgatcagaactaacacccattaaaaacataaaatgttctttctgaaccggtcttcatggtgcgtgagagcaccaagcagctttggtatgcaggaggagttttgcacagaagagtggcctgctcaaacctgcccactgttctgtaggtgatctggtggatctggaaatttatcccaagacaggaatttcctaatattcgaagacatttgaggctttgggaaattctctgctgtgcatttatttggctcctgtcataagcttgttttttaaagaatgtatcatagctcaagtttttactgctgattttgttaaattctgtatagtatattttttacggaaaggcacagtcagacattcctaatagggctcatgtcagaacttctgttcccaaggcattatctccatagcaaaaattagtgcactgttttcaaaagtgaggtgggaaaatgcttttaagatcatgtgatgttcccctaaaaggggttaatggggtgtattcagggtttgggagggaggaagaagcatgctttagaaaacagtaaatttagggagaaaatgctttgttggttaaatgtcactcaaaaggctgaattcaaatcaattccacaaacatttactgagtacctactgcccctggggacacagagataaattatttagtctcagacacactcattctaacttcccagcacctctactgtctgcagattctttaatttattttggttgtattagctaattaattcgtaaactttaggcacatggatctattctcattatgaaaatggatgccatttgattaaggctgatgactaacaaaatgatttgtgtttactcgaagtgtttttttaaaaatagctactcaaggatagttttccataaatcaagaaggtaaaaaagttcccattttttattgtagaatccattatttaaactacatgtagagacaggttattatttgctatattcaagtttggtcatcaatacccttaaaaatattagaattttatggatgacccagaaatgctttgaaaatctgtgttcctcagcaaatacagagaccatgatcaaaatgcacagaatcactaacattttgatgctagcatggtttcagtctatttggcagaacagaattgattatgctactaaaatttctttttctttttttttttttttttttttgagacagagtcttgctttgtcacccaggctgaagtgcagtggcaggatctcagttcactgcaacctctgcctcccaggttcacgccattctcctgcttcagcctcccgagtagctgggactacaggctcccaccaccatgcccggctaattttttgcatttttagtagagacggggtttcaccgtgttagccaggatggtctcgatctcctgacctcgtgatccgcccgcctcagccttccaaagtgctgggattacaggcgtgagccactgtgcccggactctgattttttttttactaaggtacagtaagaaaagggaaaagtgtacgttttcacttcctgaaatatgtcaggttgaatcaataatagagcacaccagaactcttggctccatttcaacctaaactattcagttctcatcaccccagaggaaattccgcctctgtgctggtcagtaatccccctggattataaaagtttaactaactcactgtgcacaaggcacggccattgccaacattctcttgcaaggtattttcccaagcccttacccaattctgtttccatgattgtgacattggggattaattctgcaagacagaactgtttatattctgtaccttaaaaacacatgcaaacatctcttgccttaagatttctggctttcctatggcccagagtcctagaagtgttttgatatttgtagcagaattttcaagtgtacatccttatcctggatattaacatttttgcatcatattggcagctggacctacagagaatttagtagactgttaacctaataagccttgaatccttttgcaccagtggtgagagaatgtggatcagagccatcacctccatgccccgtcaccctctaacaaccacatttacaacttccccagctctgagacacacttgcctccaccccttccatcaccccattttaagatgaaaataccacaccagcctggaaggaagaagttacttgcccagggccacatagtgagttaagggctgatctagagctaggaagctgtcttcctgaaccataatcctggactcttctaacctctctactcatcgcaaatagagttcattttagtgatttgaaggaagatgggacaagtattttcaaacacctgtaggacaacatggaagtgggaggagacttctactgtagctccccagagaagagagctagggctacagagttgcagttacaaggttgccctctctggcttgatccccaaaggaattttctactccaaaatagaatttttctaggatgctatttctcagtccctggagatactcaaacaaagggcttgtcacaagggtttttgtagaagctattcttcacagaggttgggggagagattaagccaaaggatctctgaggtctttttcaaatctataattatgtggccttttgttcattgacttccatgtgttctagttgatcattacaaacctggcaggccttctcaagggttcagtaattagctgtcatttcccatttgtccagagagtgtccaacacaaaatacccctaagatcttggccaatagagaaatgtcatggaattttagaaatgacagtatctgcggagtttattccaagttatatcatttcaaagatgaagaaacccaggctcagagggagccatcacatccacaccctgtcacccttcgtggccagtgccagacagtagctagttggatgctaaaagtagaatttagatatcttaacaataagcccagcagtctttcaacttcattcgtaaatcatttttgttttgagcatctgtcacgtggcagcacttgcctggatactggagagctgagaaggaatgcgacaggcaagtcctactctcacagtgtatacattcaggaggaacaagacacacagtgccaagtaaataaagtagctgaacttcatcaaatgattttattcttaaagtcattaaagcatgtaatgttcccctttttttgtttcaggggtgtacagattgaagaagtgtaggtgtttatgtggttttagtgacaaaccccatgtgctttcattgattttatgttttatgttaaaacatcaaccgcaaggtaaaatgcatattgtatgttgttggatacgtacttaactggtatgcatcccatgtctttgggtactagtgtatgaattctaatctctgtaaatgaaatgttgtatgtgttaatatatttaatagatgtaacttaataaactggcattgaagactgaa

SEQ ID NO: 134 - protein, 251 aa, Homo sapiens
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 135 - DNA, 5777 bp, Mus musculus
atcagaagtctctccaagacagcagaaggatggcagaggagctggggttgggcttcggagaaggagtcccagtggaagtgctgccggaaggctgtagacacaggccagaggccagggccgggctagctgccaggagcaaagcctgcctggctctcacctgctgcctgttgtcatttcccatcctcgcaggacttagcaccctcctaatggctggccagctccgggtccccggaaaagactgtatgcttcgggccataacagaagagagatctgagccttcaccacagcaagtttactcacctcccagaggcaagccgagagcacacctgacaattaagaaacaaaccccagcaccacatctgaaaaatcagctctctgctctacactgggaacatgacctagggatggccttcaccaagaacgggatgaagtacatcaacaaatccctggtgatcccagagtcaggagactatttcatctactcccagatcacattccgagggaccacatctgtgtgtggtgacatcagtcgggggagacgaccaaacaagccagactccatcaccatggttatcaccaaggtagcagacagctaccctgagcctgcccgcctactaacagggtccaagtctgtgtgtgaaataagcaacaactggttccagtccctctaccttggggccacgttctccttggaagaaggagacagactaatggtaaacgtcagtgacatctccttggtggattacacaaaagaagataaaactttctttggagctttcttgctataaggaggagaaaaccatcattccaaggggctcccctgcctcctactttccaatttccttttctcatatggatctataaacaggggctttagagggatcagggaaggggacagtggtttagctatataatttaggaacccaatattgatccgtatatgccttatggactaaaatagtaaatggaaaacccagtacagctcatgtttgatagagacctgctgggttttaaaaattgaaacacgcctcatccaatggcacaatctactgatttcaggacagaacctttccacagtgccctctgtccaagtcctttctgaattcagcagttcagttagagctgaattcgacaatgaacttactccagatcaagagctaaagacagaatccaaagaaagactgagaaaatgatgttatttctccaagaggcaatgcatttccacattcttttgtgcctaacctaaaaaataagaaagaagaaaggaaggaaggaaggaaggaaggaaggaaggaaggaaggaaggaaggaaggaaggaaggaaggaaggaagggacaagaaaagacaagacaagacaagaaaaaagaaaaaatggtatttctcgtgaatattccctaaaaggaattggttttctgctgtgaaggagaaacctcacctttcttctgattgcatcctttagtatccaaacatacaagtgggaattccaaatgcacatggaacatagaacacttttattattgtgagaacatgtttattgagtacctactatgctctgggcactcagcccacaggaccatgaagagaaagtcaaattttcttaaaaactaaatgaatcctcaatacatacttcctgatcaactaccactcaaaatgtataacttccaaagtataacttcaagtcagccatctaggtggtttcttgggtaaaggtgcttgtcattaagcctgacacctgggtttgacctcccagaacccaaaagctggaaggagagaattggttcccacaaattatcctcaaacccccatacaaatgatgtggcatgcacacatgtaactaaataaataagtgtaaaacaaaaacaaaaacaaaattttaaagaaaaatttcaagtcctgaaagacagcattcctgagaatgttgtctccatcgttgtccagtataggctaaccagctgatagagacactgaaggaatttaaagacagacatcaagtgaaatggagcactgtagaaacacttgattcatgccaggagtcaatgtactatgaagaccaacaacaaagtgtcagtcatcaaatccagaggtgtttatctagatctgctttcaagtttggtttgcagcctttatatagtctctattacaaatgctcgtgtcatggtagatgccacaaggagtcagagggtaaacttagccccaaaccactgctgagccatcttctaggaaaccttcgaagcagagctgggcagcgtgactcccacacaatgactgggaaagtagtagctgatcaaaatttgttgagtaataatttgttagaaaattcatctccactgcctactaaacctaagttgtatactatctagcttctgctaagccaacttacattggccactttttctgtcttcaacttcttgaagtatcacaggtctcagtgagaacacagggaaaggtgaggtcgccttcccctggttcttcataggggaaaccacacctgaaagaagatgagcagcctgaggtgacctggaggaagggctgtctcagaagaaggacttattttttggcttaggtctaaaaccttgagagtaatgctcactggtcaattgaggatgctttatcaatgactccagtctgactccaaggtcagaaaggagagtgagatgctctctctgcctgcatatatcttcatggaacatgagaatattgagcaacatagacttataggaaaacacttgcccaaaagtagccagagtgacctggtcatcccctctactaaacccaagctttgtgtcaagggccttcaaagctgcccagaagtgatctggatggcttgggaatttatccaagacaggaatttcctgacagccaaagatgcttgagtccttgtgcctgacatgcatttattttgcccctgtttattgaagactgtaactgttgatttgtgggtatacatacatacatacatacatacatacatacatacatacatatgctgtcatgaaggcagcatcaaacattactaattggactcaaaccagcatttctgtttccaagatactaagtattcccatgcaaacaggagcatgctatttttctaaagcaaaatgaaaaaaatagttttgaaagtatatatatgatggagtcaagtgtaatggcatacatctgtaaacccagcacatgggatgctgagccaggaggattgccgtgagtttgaggagaacaggggctaaatagtaattttcaggaaagccttgcctatataacaagaccttgtctcaaatgaaaaaaaaaaaaaaaatagaccccaggctggtccttggagataaggtaatatattcattgggtgagggggtgtgtgttttggaaaatagttaatttagtgagaaatgcttttcggtcaaatgcatctcaaaggctgctgaattcaaatcgggtctgtaaatgcttacctagtgcttgcttgccctggggacagagacataaattactttagtctcagatccactcgttctaacagattggcatctccatcgtctgtggagcttttaatcactctgtttgtattagctaattaattagctaacttgagacacactgatattttcttattataaacatgggtgccatttgataaaagacaatcattaacaaaatggttcgaatttccgcttaagtgatcttcttttttccttttcattttttttaactagctaatcaaaggtagtttcccaaaaataaatgcaaagggagtataaagaaaaaattccctgtggtgggagctagtattgaaacaacagtatcaaagaggctgttacctactggcctcaaattttggcaggaacgcctttgaaaatgttagaactttacggacagcctagaggtgctttgaaaagtctctgttgccaacaaaagccattaatcagcatgcggcacaggttactcaaattttgaccttgactgttttttagatctgttacacagaacacaacttctgggctgtaatctctgatgtggatttggtgatttactaaggtaccgtgggaaacaaggaaagtgtacttgtaccacatcgtttctcagtgcatgtcagagtctactcaacagcagggcatgccagagccttggatacattccgggacaaactatgtcactcctaaggaaattccaagtgtgtgcctgtcaagcactctggatcatagaagcccacgagttcactgtgcacaaggcacagccatggccagcactctcttgcatggtatttctcttaagctcttactcaatcacggtcccatgattgtgacattggggattaattgcttgagcaggtttatttacagtctgttccttgcaaaatacatgcagatatgtctggcctcaaaatcccctgattgttttagggcttagagaatactggggatgtttttgctgttttcagatgtactttatttaagcttgcagaattaccctgaatattaacagtgttctaagatattgcctgctagcttctggctaatttactagtggtgacagtatcagatcagagtatctatatttatgtcttgctattatagttaaaacttcctgatctctgtaacacactcacccctacctcatctatctacccatcttgtggatgtagctgtgagaagactcacaagcccgagttgcagttacttttctgaagcaacatagtatgttaatggaatggccagaactctactcttggcacatggcactgaatttgatgccactaaaagaaaaattgaaggcagaaatattttttactatgcatgggacaacgtagaagagcaaggagactgcttacacatggtggtcacatctctggcttcatccctaaaccaattttctgaccccaagtcgattttttttcatgtagttattgttcattttctggaaagagtcaagcaaaaagagagttttatagaaaccattgcatcatggaggtcaggggagggattaagccaaagaattccttctccaaatctatagccatatggccaccctttggtgtacttctatttgatcatgacaaacctgagagccctgcccagagttcagtggatcctaatgaactccaagagtaattcattccctcaccaactctaggggcttggccagtgcagaaaatgtcatgggattttaaagttaacatgagctgctatccaaacttatgtctctttaagaatggagagacacaggccaggagaggtaacatatgaagcctggtattgggcagtagcttgatggagtattgaggctaaaagtagacttcctgcccctgaccatacacaacaccctttcagtttgatccatggtggtcttattctactttattttgagcacctgtcacacctagttactgtcatgccaagaaggtccataacaggcaaatcctactctgctgtgtgcacacaagaggaaggaggctcacagtagcaagtaaacagataagcaaacgtacacgattttcgtcttaaagtcattaagacacacgcgtacccctcttttgtttcagagggtatacaggctgaacagatgtcagtgttcacctattcttattgataagccccatgtgctttcattggttgaatgttttatgttaaaacgtcatattgccatcgtaaaatgcatattgtatgttgttgggtatataattaactaatatgcatcgcatgtatgaattctaatctctgtaaatgaaaacttatatatgttaacatatgtaatagttataatttaataaactgacactggagactac

SEQ ID NO: 136 - protein, 252 aa, Mus musculus
MAEELGLGFGEGVPVEVLPEGCRHRPEARAGLAARSKACLALTCCLLSFPILAGLSTLLMAGQLRVPGKDCMLRAITEERSEPSPQQVYSPPRGKPRAHLTIKKQTPAPHLKNQLSALHWEHDLGMAFTKNGMKYINKSLVIPESGDYFIYSQITFRGTTSVCGDISRGRRPNKPDSITMVITKVADSYPEPARLLTGSKSVCEISNNWFQSLYLGATFSLEEGDRLMVNVSDISLVDYTKEDKTFFGAFLL

SEQ ID NO: 137 - DNA, 2737 bp, Homo sapiens
aaaccctctgtaaagtaacagaagttagaaggggaaatgtcgcctctctgaagattacccaaagaaaaagtgatttgtcattgctttatagactgtaagaagagaacatctcagaagtggagtcttaccctgaaatcaaaggatttaaagaaaaagtggaatttttcttcagcaagctgtgaaactaaatccacaacctttggagacccaggaacaccctccaatctctgtgtgttttgtaaacatcactggagggtcttctacgtgagcaattggattgtcatcagccctgcctgttttgcacctgggaagtgccctggtcttacttgggtccaaattgttggctttcacttttgaccctaagcatctgaagccatgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataacagtgtccgcagaagcaaggggctgaaaagatctgaaggtcccacctccatttgcaattgacctcttctgggaacttcctcagatggacaagattaccccaccttgccctttacgtatctgctcttaggtgcttcttcacttcagttgctttgcaggaagtgtctagaggaatatggtgggcacagaagtagctctggtgaccttgatcaaggtgttttgaaatgcagaattcttgagttctggaagggactttagagaataccagtgttattaatgacaaaggcactgaggcccagggaggtgacccgaattataaaggccagcgccagaacccagatttcctaactctggtgctctttccctttatcagtttgactgtggcctgttaactggtatatacatatatatgtcaggcaaagtgctgctggaagtagaatttgtccaataacaggtcaacttcagagactatctgatttcctaatgtcagagtagaagattttatgctgctgtttacaaaagcccaatgtaatgcataggaagtatggcatgaacatctttaggagactaatggaaatattattggtgtttacccagtattccatttttttcattgtgttctctattgctgctctctcactcccccatgaggtacagcagaaaggagaactatccaaaactaatttcctctgacatgtaagacgaatgatttaggtacgtcaaagcagtagtcaaggaggaaagggatagtccaaagacttaactggttcatattggactgataatctctttaaatggctttatgctagtttgacctcatttgtaaaatatttatgagaaagttctcatttaaaatgagatcgttgtttacagtgtatgtactaagcagtaagctatcttcaaatgtctaaggtagtaactttccatagggcctccttagatccctaagatggctttttctccttggtatttctgggtctttctgacatcagcagagaactggaaagacatagccaactgctgttcatgttactcatgactcctttctctaaaactgccttccacaattcactagaccagaagtggacgcaacttaagctgggataatcacattatcatctgaaaatctggagttgaacagcaaaagaagacaacatttctcaaatgcacatctcatggcagctaagccacatggctgggatttaaagcctttagagccagcccatggctttagctacctcactatgctgcttcacaaaccttgctcctgtgtaaaactatattctcagtgtagggcagagaggtctaacaccaacataaggtactagcagtgtttcccgtattgacaggaatacttaactcaataattcttttcttttccatttagtaacagttgtgatgactatgtttctattctaagtaattcctgtattctacagcagatactttgtcagcaatactaagggaagaaacaaagttgaaccgtttctttaataa

SEQ ID NO: 138 - protein, 288 aa, Homo sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 139 - DNA, 1701 bp, Mus musculus
gagttttatacctcaatagactcttactagtttctctttttcaggttgtgaaactcaaccttcaaagacactctgttccatttctgtggactaataggatcatctttagcatctgccgggtggatgccatccaggcttctttttctacatctctgtttctcgatttttgtgagcctaggaggtgcctaagctccattggctctagattcctggctttccccatcatgttctccaaagcatctgaagctatggcttgcaattgtcagttgatgcaggatacaccactcctcaagtttccatgtccaaggctcattcttctctttgtgctgctgattcgtctttcacaagtgtcttcagatgttgatgaacaactgtccaagtcagtgaaagataaggtattgctgccttgccgttacaactctcctcatgaagatgagtctgaagaccgaatctactggcaaaaacatgacaaagtggtgctgtctgtcattgctgggaaactaaaagtgtggcccgagtataagaaccggactttatatgacaacactacctactctcttatcatcctgggcctggtcctttcagaccggggcacatacagctgtgtcgttcaaaagaaggaaagaggaacgtatgaagttaaacacttggctttagtaaagttgtccatcaaagctgacttctctacccccaacataactgagtctggaaacccatctgcagacactaaaaggattacctgctttgcttccgggggtttcccaaagcctcgcttctcttggttggaaaatggaagagaattacctggcatcaatacgacaatttcccaggatcctgaatctgaattgtacaccattagtagccaactagatttcaatacgactcgcaaccacaccattaagtgtctcattaaatatggagatgctcacgtgtcagaggacttcacctgggaaaaacccccagaagaccctcctgatagcaagaacacacttgtgctctttggggcaggattcggcgcagtaataacagtcgtcgtcatcgttgtcatcatcaaatgcttctgtaagcacagaagctgtttcagaagaaatgaggcaagcagagaaacaaacaacagccttaccttcgggcctgaagaagcattagctgaacagaccgtcttcctttagttcttctctgtccatgtgggatacatggtattatgtggctcatgaggtacaatctttctttcagcaccgtgctagctgatctttcggacaacttgacacaagatagagttaactgggaagagaaagccttgaatgaggatttctttccatcaggaagcctacgggcaagtttgctgggcctttgattgcttgatgactgaagtggaaaggctgagcccactgtgggtggtgctagccctgggcaggggcaggtgaccctgggtggtataagaaaaagagctgtcactaaaaggagaggtgcctagtcttactgcaacttgatatgtcatgtttggttggtgtctgtgggaggcctgcccttttctgaagagaagtggtgggagagtggatggggtgggggcagaggaaaagtgggggagagggcctgggaggagaggagggagggggacggggtgggggtggggaaaactatggttgggatgtaaaaacgataataatataaatattaaataaaaagagagtattgagcaaa

SEQ ID NO: 140 - protein, 306 aa, Mus musculus
MACNCQLMQDTPLLKFPCPRLILLFVLLIRLSQVSSDVDEQLSKSVKDKVLLPCRYNSPHEDESEDRIYWQKHDKVVLSVIAGKLKVWPEYKNRTLYDNTTYSLIILGLVLSDRGTYSCVVQKKERGTYEVKHLALVKLSIKADFSTPNITESGNPSADTKRITCFASGGFPKPRFSWLENGRELPGINTTISQDPESELYTISSQLDFNTTRNHTIKCLIKYGDAHVSEDFTWEKPPEDPPDSKNTLVLFGAGFGAVITVVVIVVIIKCFCKHRSCFRRNEASRETNNSLTFGPEEALAEQTVFL

SEQ ID NO: 141 - DNA, 2720 bp, Homo sapiens
agtcattgccgaggaaggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctcttgaagaactgactagtgagatggcctggggaagctgtgaaagaaccaaaagagatcacaatactcaaaagagagagagagagaaaaaagagagatcttgatccacagaaatacatgaaatgtctggtctgtccaccccatcaacaagtcttgaaacaagcaacagatggatagtctgtccaaatggacataagacagacagcagtttccctggtggtcagggaggggttttggtgatacccaagttattgggatgtcatcttcctggaagcagagctggggagggagagccatcaccttgataatgggatgaatggaaggaggcttaggactttccactcctggctgagagaggaagagctgcaacggaattaggaagaccaagacacagatcacccggggcttacttagcctacagatgtcctacgggaacgtgggctggcccagcatagggctagcaaatttgagttggatgattgtttttgctcaaggcaaccagaggaaacttgcatacagagacagatatactgggagaaatgactttgaaaacctggctctaaggtgggatcactaagggatggggcagtctctgcccaaacataaagagaactctggggagcctgagccacaaaaatgttcctttattttatgtaaaccctcaagggttatagactgccatgctagacaagcttgtccatgtaatattcccatgtttttaccctgcccctgccttgattagactcctagcacctggctagtttctaacatgttttgtgcagcacagtttttaataaatgcttgttacattca

SEQ ID NO: 142 - protein, 329 aa, Homo sapiens
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 143 - DNA, 2539 bp, Mus musculus
attgctgaggaagaaagaggagcaagcagacgcgtaagagtggctcctgtaggcagcacggacttgaacaaccagactcctgtagacgtgttccagaacttacggaagcacccacgatggaccccagatgcaccatgggcttggcaatccttatctttgtgacagtcttgctgatctcagatgctgtttccgtggagacgcaagcttatttcaatgggactgcatatctgccgtgcccatttacaaaggctcaaaacataagcctgagtgagctggtagtattttggcaggaccagcaaaagttggttctgtacgagcactatttgggcacagagaaacttgatagtgtgaatgccaagtacctgggccgcacgagctttgacaggaacaactggactctacgacttcacaatgttcagatcaaggacatgggctcgtatgattgttttatacaaaaaaagccacccacaggatcaattatcctccaacagacattaacagaactgtcagtgatcgccaacttcagtgaacctgaaataaaactggctcagaatgtaacaggaaattctggcataaatttgacctgcacgtctaagcaaggtcacccgaaacctaagaagatgtattttctgataactaattcaactaatgagtatggtgataacatgcagatatcacaagataatgtcacagaactgttcagtatctccaacagcctctctctttcattcccggatggtgtgtggcatatgaccgttgtgtgtgttctggaaacggagtcaatgaagatttcctccaaacctctcaatttcactcaagagtttccatctcctcaaacgtattggaaggagattacagcttcagttactgtggccctcctccttgtgatgctgctcatcattgtatgtcacaagaagccgaatcagcctagcaggcccagcaacacagcctctaagttagagcgggatagtaacgctgacagagagactatcaacctgaaggaacttgaaccccaaattgcttcagcaaaaccaaatgcagagtgaaggcagtgagagcctgaggaaagagttaaaaattgctttgcctgaaataagaagtgcagagtttctcagaattcaaaaatgttctcagctgattggaattctacagttgaataattaaagaacaaaatacacaacagtgtccatattttatcctgtttcctttccaagtttttgggcaatgtcaattgtgtcccctatgccaggagcagacatctattttgtcttgctttgtttaactcagtgcacactcataggccaagagcactgaaatggcttctttcccaggaataacattttggatcaatctctcctacttgagatcagattcttcttctaattttgcatagtgtgtttttatatggaactccttgttgtaggaatactggcttttatctgtcttgcacacttgcatacttatatacttatacctggacagctacctcttcagtcaggatgggagtggtatatttggtgatgttatttgatgtgttcgtgttgctatcttaaaacagcaaagagcatatactatagtagctcaactacaatgatctagagaaagacccagcacttataagaaacactgtccctccatcagggtcaataatgaatacaatgacctaagtaatatacaggtgacagcaacagcacagagttctcagtgctggcaaatcaagaaacacaaatatggaaccatctctagatccaagagccactcctacctgggctgccacagatactggaagaatccacctgcctggccagcaagtcacaacttagcaggcagcactgaagaaagcaagatgtactgtatgcccttttaagaaaatgcctggaaaggtctggagaatgctgtgcaaggataagacagccaagcactcaaaaccaggagacatcactagaatccaaccaacaaatgtttatggaaggactgatctgcccagtccattgaaaagtcaagaggtcagagatagaccagtgtgtgtctcaatggatgtagatatcagccacctcggtgctcaacaggtattttatgatctccttgtttcaaattcatctagatgtagaactagggagagagcagtcacattgatgaaaggctaggactctttcagctcatggcttgtgtggaaggagggaaagcagaaatcacaacactctgagactactgtagtctgcagatacctgagtgggtgtggcttggcctttcaaaggacaaagagcaactaatgctgaaagcacatagtgtatctatacggcatggaatagtcatcacccagacttaaagagaactttggcaggtctgagcagcaaaatattgttgtttccattttacataaagggccctggagggctatagactattccgctggcagggctcatgcttgtaatgtgtccatcttgattcaccctgtgcagactcttaagatctggccagttaccaacatgttctgtacagagtggatttcaataaagttttcttgaattttttcaag

SEQ ID NO: 144 - protein, 309 aa, Mus musculus
MDPRCTMGLAILIFVTVLLISDAVSVETQAYFNGTAYLPCPFTKAQNISLSELVVFWQDQQKLVLYEHYLGTEKLDSVNAKYLGRTSFDRNNWTLRLHNVQIKDMGSYDCFIQKKPPTGSIILQQTLTELSVIANFSEPEIKLAQNVTGNSGINLTCTSKQGHPKPKKMYFLITNSTNEYGDNMQISQDNVTELFSISNSLSLSFPDGVWHMTVVCVLETESMKISSKPLNFTQEFPSPQTYWKEITASVTVALLLVMLLIIVCHKKPNQPSRPSNTASKLERDSNADRETINLKELEPQIASAKPNAE

SEQ ID NO: 145 - DNA, 1086 bp, Homo sapiens
gaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtattctgaaatgtgacagaaaaccagacagaaccaactccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaagtga

SEQ ID NO: 146 - protein, 250 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 147 - DNA, 3749 bp, Homo sapiens
agacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcagaaacaaaaccatgggcagtgtatgctgggctgttagggggtgtcatcatgattctcatcatggtggtaatactacagttgagaagaagaggtaaaacgaaccattaccagacaacagtggaaaaaaaaagccttacgatctatgcccaagtccagaaaccaggtcctcttcagaagaaacttgactccttcccagctcaggacccttgcaccaccatatatgttgctgccacagagcctgtcccagagtctgtccaggaaacaaattccatcacagtctatgctagtgtgacacttccagagagctgacaccagagaccaacaaagggactttctgaaggaaaatggaaaaaccaaaatgaacactgaacttggccacaggccccaagtttcctctggcagacatgctgcacgtctgtacccttctcagatcaactccctggtgatgtttcttccacatacatctgtgaaatgaacaaggaagtgaggcttcccaagaatttagcttgctgtgcagtggctgcaggcgcagaacagagcgttacttgataacagcgttccatctttgtgttgtagcagatgaaatggacagtaatgtgagttcagactttgggcatcttgctcttggctggaactggataataaaaatcagactgaaagccaggacatctgagtacctatctcacacactggaccaccagtcacaaagtctggaaaagtttacattttggctatctttactttgttctgggagctgatcatgataacctgcagacctgatcaagcctctgtgcctcagtttctctctcaggataaagagtgaatagaggctgaagggtgaatttcttattatacataaaacactctgatattattgtataaaggaagctaagaatattattttatttgcaaaacccagaagctaaaaagtcaataaacagaaagaatgattttgagatctctgagttttgaacagtggactggaaaccatgtaagagccttaaaagtacagttctgtgcaaatggcattcagttttaaagaaaaacgtagcaaatgtttgatggtgctgttacaaaggagcttggaatactcagaggaacttgtcccatggtgatttttcacttctcaaaatgatgtttaaatcccagttctctgttgattcccttgaacaacaaacctggaacctcagctaagactctctgtgaccagattctgaacctcttatatccagggcttcaaggggtattgcaggtcaaggtctttcctaggcactttctactccctgcatacctctcctcacactaaatttatcctctagtagaaaattaagttattttggtctaacagcttcaaatctttgaatgctcaataacttattttgcaagctgcaggcagaaagagactttttaagtaaagtcctttgttttttcctattctctgcttttagacaggctgtcctcaatttaagccctgctttttcttattgtttcttatataaacttggtaagtactgtaagaaacagccactatcataccattgcataataaggagcaccaacttcccagctcaaaactcaggtccttattgccttgtatcttacctcctctatgaggtcaattcacattgtaagcctgttgcttagtgcatctcgtttcctggtaccagcttctttaatagagttcttagttgcaatcaacagaagctggctttggcttttttatgtagaaaaggaacctattgaaaagatactgattggttccaataactgctagaagtttctgcaaaaccatgctttgaaagtgagcaggaaaagaagagactaggctgtggctgggagcacagccaaaattacaaaaccagcccagggatgatgatcctgttcatgcacagccactgtccccagcactaggcacagactctaccactgcctcactgtctctgctggacttggaaacttgatattactgttactgctgcactgtctgccatgaaaatgaattctccagggtcccttcttcatcctttcatctctagcttataattcaaagtctgggattgagtggccaatcctaggtcacatgtccatgtcctatctccaaggggggctgggaattgaatatctggcattttccactttcacttcttatgaattaaggaattctacaaataatagaagtgggattcaggtggtaggcagacaaaaaagcctcacaattatccactacgccacccttgtataaccttaccctcattcactgtctactctcaaaactgtggagctactaatgaagatttgtaaacccgggcttatgagcacccattcctttactacaactcagattgctctagaagctcagttcccagcacttggatttttccagtagctgaattctacctgaaggaagggcagaaacaaagggtgaagaagaggctatcacttccaagtatcctgcacccctgggctcaagacctcactggggagggagtcttttgggccacccaccaaacagcactggcattatgcctctcaccctagaccatggttacacgtggtaaaacaaccccttctggtgatacattcacaactctctagtttcccccaaatggcactatggggagcgggagcttgccttttcctcagacttaaaacaataagttttccccgtgtttcccctctaatgctgttttcttttgaccaagcatgtctgaattctagagaagtcaggaggaacacacccattctcggtttgaagggactgatgttctgaagtacaactgggcacagtcccaggctcttcaggacgcttcctccattcacacagcggggatgtgattgttacagcgggtggtgtgtgctggctgagaagccactgtgaattgattcttcttctgaagtttatgtttctactttttggaaatgaataaattacagccagtccatcaaggaaa

SEQ ID NO: 148 - protein, 335 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGPLQKKLDSFPAQDPCTTIYVAATEPVPESVQETNSITVYASVTLPES

SEQ ID NO: 149 - DNA, 2688 bp, Mus musculus
gagcttcttccttgggggtaacagtaagcagctgtcctgccgagctgagctgagctgagctcacagctggggaccctgtctgcgattgctggctaatggatcccaaaggatccctttcctggagaatacttctgtttctctccctggcttttgagttgagctacggaacaggtggaggtgtgatggattgcccagtgattctccagaagctgggacaggacacgtggctgcccctgacgaatgaacatcagataaataagagcgtgaacaaaagtgtccgcatcctcgtcaccatggcgacgtccccaggaagcaaatccaacaagaaaattgtgtcttttgatctctctaaagggagctatccagatcacctggaggatggctaccactttcaatcaaaaaacctgagcctgaagatcctcgggaacaggcgggagagtgaaggatggtacttggtgagcgtggaggagaacgtttctgttcagcaattctgcaagcagctgaagctttatgaacaggtctcccctccagagattaaagtgctaaacaaaacccaggagaacgagaatgggacctgcagcttgctgttggcctgcacagtgaagaaaggggaccatgtgacttacagctggagtgatgaggcaggcacccacctgctgagccgagccaaccgctcccacctcctgcacatcactcttagcaaccagcatcaagacagcatctacaactgcaccgcaagcaaccctgtcagcagtatctctaggaccttcaacctatcatcgcaagcatgcaagcaggaatcctcctcagaatcgagtccatggatgcaatatactcttgtaccactgggggtcgttataatcttcatcctggttttcacggcaataataatgatgaaaagacaaggtaaatcaaatcactgccagccaccagtggaagaaaaaagccttactatttatgcccaagtacagaaatcagggcctcaagagaagaaacttcatgatgccctaacagatcaggacccctgcacaaccatttatgtggctgccacagagcctgccccagagtctgtccaggaaccaaaccccaccacagtttatgccagtgtgacactgccagagagctgacccatatacccagtgaaaggactttttgaaggaggatagaagaaccaaaatccacactgaactggaccccgggtcccaagttctctgtgacagaaactgcacatctgtaaccttctccaatcagttccctggtgacggatctgcacaggcgtgcttatgaagtagatgagaagtgaggcttcctgggcatgcaacctgctctgctgctgacacagatatgaagcagagatcccgtggtacagtgtaccatctttgctgtagcagataatgtgggtttaggcatctcactctttgctggactggataacagaactcaaaaaaaaaccaacaagccaaagacatagactccatctcagatggctgagcacaaagtataaaagccattttggctctctggactttattctggaagctgatcctgatcacctcaaggccaagggctccatgcctcagtttctctctcaccctctagatgaagagggaacaaagcataaagagtgaaatccttgttgtctgagatcattctataaacgaactgacattttatttgcaaaactcaagctagtaattcagtagacttgaagatgattttagagcctcttatgcttcaaacaacagaatgaaatccatccaatgttcttcaaagtgtggttctctgattaagtcaaagcaacactgtttggcaatgctgctgtaaagttgcctggaatactcagaggaacttgtcccagggaggtttttttcacttcttcaaagaacttttgaatttaagttctctgtttattcccttgagcaaaactctggaacctcaagagtctctctccgttggttctgaggccattttatagcctaggcctcctgtggatctacatgtgtatcacccacttcctatctcactgcatacctctgtgtagtagtaaatttaacctcaagtagaaaattaaattattttggatgatcagttccaaatgattagatgtttagtctcttataataggatgtaggtagagtctatataaagtcctatattcttcacgttgtctgtcctcagagagaccatctttcaacctatcttccttcttgcacaactttggcaaatactttaaaaataaccattgtggagatggggagaggtctaaatggataatagtacttgctttgcaaacatgaagatctgggttcaaactcccagtgtccatgtaaaaagataagtgtggttgagtgtgccagtaacatagacacagataggtcctgagactttgctccctagccttcccagccaggcataaatgtcaagtcccctgagagtgacagaggaagatactccccccacacacacacacatacacgcacagtgatacacatatacatgcatacaaaaaaaaaacttattgtaacaaagaacaccaactgcctggctcaaaactctcatgtcccattactctgtacctttctgtatttagataatttacagtgtgagttctgctgttccatgtatcctatttgtgttactaacttatgtcaaagtatttctaattataatcaacaaaagctaactttg

SEQ ID NO: 150 - protein, 343 aa, Mus musculus
MDPKGSLSWRILLFLSLAFELSYGTGGGVMDCPVILQKLGQDTWLPLTNEHQINKSVNKSVRILVTMATSPGSKSNKKIVSFDLSKGSYPDHLEDGYHFQSKNLSLKILGNRRESEGWYLVSVEENVSVQQFCKQLKLYEQVSPPEIKVLNKTQENENGTCSLLLACTVKKGDHVTYSWSDEAGTHLLSRANRSHLLHITLSNQHQDSIYNCTASNPVSSISRTFNLSSQACKQESSSESSPWMQYTLVPLGVVIIFILVFTAIIMMKRQGKSNHCQPPVEEKSLTIYAQVQKSGPQEKKLHDALTDQDPCTTIYVAATEPAPESVQEPNPTTVYASVTLPES

SEQ ID NO: 151 - DNA, 1682 bp, Homo sapiens
agtggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaa

SEQ ID NO: 152 - protein, 277 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 153 - DNA, 1621 bp, Mus musculus
agcagggactttggagtgacttgtggcttcagcaggagccctgtgatttggctcttctgatctcgccctgcgatggtgtctttgcctcggctgtgcgcgctatggggctgcttgttgacagcggtccatctagggcagtgtgttacgtgcagtgacaaacagtacctccacgatggccagtgctgtgatttgtgccagccaggaagccgactgacaagccactgcacagctcttgagaagacccaatgccacccatgtgactcaggcgaattctcagcccagtggaacagggagattcgctgtcaccagcacagacactgtgaacccaatcaagggcttcgggttaagaaggagggcaccgcagaatcagacactgtctgtacctgtaaggaaggacaacactgcaccagcaaggattgcgaggcatgtgctcagcacacgccctgtatccctggctttggagttatggagatggccactgagaccactgataccgtctgtcatccctgcccagtcggcttcttctccaatcagtcatcacttttcgaaaagtgttatccctggacaaggtttaaagtcccggatgcgagccctgctggtcattcctgtcgtgatgggcatcctcatcaccattttcggggtgtttctctatatcaaaaaggtggtcaagaaaccaaaggataatgagatcttaccccctgcggctcgacggcaagatccccaggagatggaagattatcccggtcataacaccgctgctccagtgcaggagacgctgcacgggtgtcagcctgtcacacaggaggatggtaaagagagtcgcatctcagtgcaggagcggcaggtgacagacagcatagccttgaggcccctggtctgaaccctggaactgctttggaggcgatggctcggctcgggagcaggggcctggctctgaggactgcttgctgacctttgaagtttgagatgagccaagacagagcccagtgcagctaactctcatgcctgccccctatcatttctcaacttgctttttaaggatggagggagagctcgggcatcgggggtccacagtgatacctaccaagtgcagcagtgcaggacccagagtcgtcttgctgcggcgttcactgtaaggagtcatggacacaggagtccgtggcccacagcttgtgctgctagagggcacctggttgcccatcagcagggtactggctaaataaatctgtaattatttatacaatgacatctcagaaactctagcaggtggggcagaaaacaggtagtagaatgatgggtagagaaatagcttttaaaacacattccaaggcaggtaagatggcttttgtgagtaaaggagcttgctgcccaaacccggttacctgattttgatccctgggacttcatggtaaaagggagagaaccaaatccagagggttgtcatttgacctccatgtgtgctctgtggtaatgtaccccgtgtgtgcacatgtgcacatatcctaaaatggatgtggtggtgtattgtagaaattatttaatcccgccctggggtttctacctgtgtgttaccatttagttcttgaataaaagacacactcaacctttatatttacaataa

SEQ ID NO: 154 - protein, 203 aa, Mus musculus
MVSLPRLCALWGCLLTAVHLGQCVTCSDKQYLHDGQCCDLCQPGSRLTSHCTALEKTQCHPCDSGEFSAQWNREIRCHQHRHCEPNQGLRVKKEGTAESDTVCTCKEGQHCTSKDCEACAQHTPCIPGFGVMEMATETTDTVCHPCPVGFFSNQSSLFEKCYPWTRFKVPDASPAGHSCRDGHPHHHFRGVSLYQKGGQETKG

SEQ ID NO: 155 - DNA, 4721 bp, Homo sapiens
acacttcgggttcctcggggaggaggggctggaaccctagcccatcgtcaggacaaagatgctcaggctgctcttggctctcaacttattcccttcaattcaagtaacaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataaggtcactttatgtcaaaattatttgagtactatgggacctggcgcagtggctcatgcttgtaatcccagcactttgggaggccgaggtgggcagatcacttgagatcaggaccagcctggtcaagatggtgaaactccgtctgtactaaaaatacaaaatttagcttggcctggtggcaggcacctgtaatcccagctgcccaagaggctgaggcatgagaatcgcttgaacctggcaggcggaggttgcagtgagccgagatagtgccacagctctccagcctgggcgacagagtgagactccatctcaaacaacaacaacaacaacaacaacaacaacaaaccacaaaattatttgagtactgtgaaggattatttgtctaacagttcattccaatcagaccaggtaggagctttcctgtttcatatgtttcagggttgcacagttggtctctttaatgtcggtgtggagatccaaagtgggttgtggaaagagcgtccataggagaagtgagaatactgtgaaaaagggatgttagcattcattagagtatgaggatgagtcccaagaaggttctttggaaggaggacgaatagaatggagtaatgaaattcttgccatgtgctgaggagatagccagcattaggtgacaatcttccagaagtggtcaggcagaaggtgccctggtgagagctcctttacagggactttatgtggtttagggctcagagctccaaaactctgggctcagctgctcctgtaccttggaggtccattcacatgggaaagtattttggaatgtgtcttttgaagagagcatcagagttcttaagggactgggtaaggcctgaccctgaaatgaccatggatatttttctacctacagtttgagtcaactagaatatgcctggggaccttgaagaatggcccttcagtggccctcaccatttgttcatgcttcagttaattcaggtgttgaaggagcttaggttttagaggcacgtagacttggttcaagtctcgttagtagttgaatagcctcaggcaagtcactgcccacctaagatgatggttcttcaactataaaatggagataatggttacaaatgtctcttcctatagtataatctccataagggcatggcccaagtctgtctttgactctgcctatccctgacatttagtagcatgcccgacatacaatgttagctattggtattattgccatatagataaattatgtataaaaattaaactgggcaatagcctaagaaggggggaatattgtaacacaaatttaaacccactacgcagggatgaggtgctataatatgaggaccttttaacttccatcattttcctgtttcttgaaatagtttatcttgtaatgaaatataaggcacctcccacttttatgtatagaaagaggtcttttaatttttttttaatgtgagaaggaagggaggagtaggaatcttgagattccagatcgaaaatactgtactttggttgatttttaagtgggcttccattccatggatttaatcagtcccaagaagatcaaactcagcagtacttgggtgctgaagaactgttggatttaccctggcacgtgtgccacttgccagcttcttgggcacacagagttcttcaatccaagttatcagattgtatttgaaaatgacagagctggagagttttttgaaatggcagtggcaaataaataaatacttttttttaaatggaaagacttgatctatggtaataaatgattttgttttctgactggaaaaataggcctactaaagatgaatcacacttgagatgtttcttactcactctgcacagaaacaaagaagaaatgttatacagggaagtccgttttcactattagtatgaaccaagaaatggttcaaaaacagtggtaggagcaatgctttcatagtttcagatatggtagttatgaagaaaacaatgtcatttgctgctattattgtaagagtcttataattaatggtactcctataatttttgattgtgagctcacctatttgggttaagcatgccaatttaaagagaccaagtgtatgtacattatgttctacatattcagtgataaaattactaaactactatatgtctgctttaaatttgtactttaatattgtcttttggtattaagaaagatatgctttcagaatagatatgcttcgctttggcaaggaatttggatagaacttgctatttaaaagaggtgtggggtaaatccttgtataaatctccagtttagccttttttgaaaaagctagactttcaaatactaatttcacttcaagcagggtacgtttctggtttgtttgcttgacttcagtcacaatttcttatcagaccaatggctgacctctttgagatgtcaggctaggcttacctatgtgttctgtgtcatgtgaatgctgagaagtttgacagagatccaacttcagccttgaccccatcagtccctcgggttaactaactgagccaccggtcctcatggctattttaatgagggtattgatggttaaatgcatgtctgatcccttatcccagccatttgcactgccagctgggaactataccagacctggatactgatcccaaagtgttaaattcaactacatgctggagattagagatggtgccaataaaggacccagaaccaggatcttgattgctatagacttattaataatccaggtcaaagagagtgacacacactctctcaagacctggggtgagggagtctgtgttatctgcaaggccatttgaggctcagaaagtctctctttcctatagatatatgcatactttctgacatataggaatgtatcaggaatactcaaccatcacaggcatgttcctacctcagggcctttacatgtcctgtttactctgtctagaatgtccttctgtagatgacctggcttgcctcgtcacccttcaggtccttgctcaagtgtcatcttctcccctagttaaactaccccacaccctgtctgctttccttgcttatttttctccatagcattttaccatctcttacattagacatttttcttatttatttgtagtttataagcttcatgaggcaagtaactttgctttgtttcttgctgtatctccagtgcccagagcagtgcctggtatataataaatatttattgactgagtgaa

SEQ ID NO: 156 - protein, 220 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 157 - DNA, 4317 bp, Mus musculus
agaccttggcagatgtgacttcagttcacaccacactctgccttgctcacagaggaggggctgcagccctggccctcatcagaacaatgacactcaggctgctgttcttggctctcaacttcttctcagttcaagtaacagaaaacaagattttggtaaagcagtcgcccctgcttgtggtagatagcaacgaggtcagcctcagctgcaggtattcctacaaccttctcgcaaaggaattccgggcatccctgtacaagggcgtgaacagcgacgtggaagtctgtgtcgggaatgggaattttacctatcagccccagtttcgctcgaatgccgagttcaactgcgacggggatttcgacaacgaaacagtgacgttccgtctctggaatctgcacgtcaatcacacagatatttacttctgcaaaattgagttcatgtaccctccgccttacctagacaacgagaggagcaatggaactattattcacataaaagagaaacatctttgtcatactcagtcatctcctaagctgttttgggcactggtcgtggttgctggagtcctgttttgttatggcttgctagtgacagtggctctttgtgttatctggacaaatagtagaaggaacagactccttcaaagtgactacatgaacatgactccccggaggcctgggctcactcgaaagccttaccagccctacgcccctgccagagactttgcagcgtaccgcccctgacagggacccctatccagaagcccgccggctggtacccgtctacctgctcatcatcactgctctggataggaaaggacagcctcatcttcagccggccactttggacctctactgggccaccaatgccaactattttagagtgtctagatctaacatcatgatcatcttgagactctggaatgaatgacagaagcttctatggcaggataaagtctgtgtggcttgacccaaactcaagcttaatacatttattgacttgattggggaagttagagtagagcaatcaaaaagatcattcattcagccttgggaagtcaatttgcaggctcctggatgagccctgccccgttttcacttgccagcacatttcagtcatgtggtgtgatagccaaagatgttttggacagagaagaaaggatagaaaaaccttctctttggctaagttggtgtttggggtggggataggttagagtatagtacttaactatttgaaaaataatgaaaacacttttttcactcatgaaatgagccacttagctcctaaatagtgttttcctgttagtttagaaagttgtggacatatttttttaatgatttctgaccatttttaatcacattgactcatggaatggcctcaaagcaccccccagtgcttctttcctcattcccggtcatgggaactcagtattattaatagtcacaacatgatttcagaactagatagccctcccacaccaagaagaatgtgagaggaagtaaggtcactttatgtaaaaaaaaaaaaaaacaaacgcgtacacatatgtatgtatacatacatacctatgtgcacacacacacacatatacatacacacaaaatgctatgaagagttatctgtttagtagcctgttatagtcaaatcattttaagtttcaacttcttacagttgggccacttgttgtcctttgtggatggatatctgaaattgtgtctatatattgctagtcatgatactgtgaacaaaaagggtagtgttagtatttgtcagggtggtaaggatgcattccaggaagcttcctctgaggaagggaatgaggtcattcttgccatgtatgaaagacatagatgttttccagaaggcaccattgggagccccagtataagttcctttagactctacagtttagagggattttatatgtcctaggactcaggactccagaactttgtgggctcagctgcttcataccatggggatacattgacatgaacaattattttggaatgtgtctttagggacgacatcaaagttctcaagtacctacaagacctgatactggaatgaaggtggactttcttttttgcttccagttcggatcaactggaatgtatctggggaccttgaagaacggctgtccagctgtcttcaccatttgtatagtgctttgaattattcagaggttttaaagtcaggaagacctggtttaaaaaacatttcattatgagttaaatggcctcaggcaagtcactgttcatccaagtctatgactcctcaactgtaagatggccacactgaaacttgctaagatcctctggcctctgcctcccaagagttgggatttcaggagtgcacaatcatgacccaaactcgtgataatctctcagcttcaataactttccagctaattggaatatcctgtaatcaaacatgaggcatttcccctccccccactgtttttgtgtataaagagatctttaaactttttttttaatatgaggggtaagaaaagataggaatcttttaattctagacagaagatattgtgctttggttttttttttttttaatggcttctattctgtgcttttaattaaaccagagaaggccaagattagccctacttgtgtgataaaagaatgctggcccttgtgattgcagtcagcctcttgacacatagagttcttgaatctaagttataaaattatatttgaaaatgacagagctggagaatttatagaaagggtcatagcaaataacaaaccatttttttttaaacggaaagatttggtctttggcaatcaataactttgttttctaactggaaaaggaggtttactggagatgaatcacacctgaaagttttcatacctcctctgaacacaaccgaaacataggtgtccaaagcctttcgctctcggtatgaaccaacaggcgggttaaaaacactgggtcagagtaaagcttttgcagtttcagatgtagtgtgtatgaagaaaactatgtcacttgctgctattattgtaagagtctaagaactaaaggtgtgcctgtaatttctaattatgagctcacctatttggtaccgagcatgccaattttaaagagacccggtgtaccttatagctacatccaatgataaaattaccacactagcacatgcctgtgtttaaactcgtgctttaatgtttttcttagggcaggtatgcaccccctttgcagtgagttgggagagattttgaaaaagtgtatgacaaacatttttaacacctttggtttcctctctctgtgtctctttgtctctgtctctctctttctctcctgtgcatatgtctcccctccctcacttctctgtctcttcctctctccctctctctgtctttctctgtgtgtctctctgtctctgtgtatctctctgtctgtctctttctctgcagattttcaaaacgttgtttttctatggaagaaatacaagctgtggttggtttgctacgagtcagtagcagtttatcagtaggccaatgttttatctcttggagatttcagtctgggtttacccaatgtattctctgtaatgtgactgctggggacagatataacttgattgagccttcaaatcatttaggtcttcaatcatttagtcaacggagtgagccactaatctgcaatggctattttaatatgcatactgatggtcaaatggatgtctgatctctcatcccagctttctgtactaccatatgggaactatatgtaacttgtatacttacctgaatatgttaaattcaactacatggtaagatggaccagaaattgcaatgttcatgtccatatagccaccattaacccaagttaagcacagtagtgtgggttctctcaggacttgtgaatgagtttatgctctctacaaagacaggtgaagcttaaatctctcttgcactgctatgtttatgcaaatatcaagattgtttctgtaccagggacttaacacattctattcatactattttccctgtctacaatgttatttcatagatatctacttggtttgctcttacttccttgacatatttgcccaaatgccaccttcaactgtagttaattacctgtacaacctgtctccatgccttgttttattttctctataactctactaataggtatttttcttatttattggtttattgcctgttttttttcctaaatctacaccggatctccaaagggaaagaactccatttgctttgattttattgctgtatccccagtgcctagaataatgcttagcctgcaataaatatttattcattgact

SEQ ID NO: 158 - protein, 218 aa, Mus musculus
MTLRLLFLALNFFSVQVTENKILVKQSPLLVVDSNEVSLSCRYSYNLLAKEFRASLYKGVNSDVEVCVGNGNFTYQPQFRSNAEFNCDGDFDNETVTFRLWNLHVNHTDIYFCKIEFMYPPPYLDNERSNGTIIHIKEKHLCHTQSSPKLFWALVVVAGVLFCYGLLVTVALCVIWTNSRRNRLLQSDYMNMTPRRPGLTRKPYQPYAPARDFAAYRP

SEQ ID NO: 159 - DNA, 1282 bp, Homo sapiens
ggaagtctgtcaactgggagggggagaggggggtgatgggccaggaatggggtccccgggcatggtgctgggcctcctggtgcagatctgggccctgcaagaagcctcaagcctgagcgtgcagcaggggcccaacttgctgcaggtgaggcagggcagtcaggcgaccctggtctgccaggtggaccaggccacagcctgggaacggctccgtgttaagtggacaaaggatggggccatcctgtgtcaaccgtacatcaccaacggcagcctcagcctgggggtctgcgggccccagggacggctctcctggcaggcacccagccatctcaccctgcagctggaccctgtgagcctcaaccacagcggggcgtacgtgtgctgggcggccgtagagattcctgagttggaggaggctgagggcaacataacaaggctctttgtggacccagatgaccccacacagaacagaaaccggatcgcaagcttcccaggattcctcttcgtgctgctgggggtgggaagcatgggtgtggctgcgatcgtgtggggtgcctggttctggggccgccgcagctgccagcaaagggactcaggtaacagcccaggaaatgcattctacagcaacgtcctataccggccccggggggccccaaagaagagtgaggactgctctggagaggggaaggaccagaggggccagagcatttattcaacctccttcccgcaaccggccccccgccagccgcacctggcgtcaagaccctgccccagcccgagaccctgccccagccccaggcccggccaccccgtctctatggtcagggtctctcctagaccaagccccacccagcagccgaggccaaaagggttccccaaagtgggagaggagtgagagatcccaggagacctcaacaggaccccacccataggtacacacaaaaaaggggggatcgaggccagacacggtggctcacgcctgtaatcccagcagtttgggaagccgaggcgggtggaacacttgaggtcaggggtttgagaccagcctggcttgaacctgggaggcggaggttgcagtgagccgagattgcgccactgcactccagcctgggcgacagagtgagactccgtctcaaaaaaaacaaaaagcaggaggattgggagcctgtcagccccatcctgagaccccgtcctcatttctgtaatgatggatctcgctcccactttcccccaagaacctaataaaggcttgtgaagaaaaagcaaaaaaaaaaaaaaaaaa

SEQ ID NO: 160 - protein, 282 aa, Homo sapiens
MGSPGMVLGLLVQIWALQEASSLSVQQGPNLLQVRQGSQATLVCQVDQATAWERLRVKWTKDGAILCQPYITNGSLSLGVCGPQGRLSWQAPSHLTLQLDPVSLNHSGAYVCWAAVEIPELEEAEGNITRLFVDPDDPTQNRNRIASFPGFLFVLLGVGSMGVAAIVWGAWFWGRRSCQQRDSGNSPGNAFYSNVLYRPRGAPKKSEDCSGEGKDQRGQSIYSTSFPQPAPRQPHLASRPCPSPRPCPSPRPGHPVSMVRVSPRPSPTQQPRPKGFPKVGEE

SEQ ID NO: 161 - DNA, 1643 bp, Homo sapiens
agtctcacttcagttccttttgcatgaagagctcagaatcaaaagaggaaaccaacccctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccaggaggcagcatccttggccagagtaatgggctctctgcctggacccctcccagccatcccacttctcttccttttgcagagaaaggtctggacatctatctcatcattggcatatgtggaggaggcagcctcttgatggtctttgtggcactgctcgttttctatatcaccaaaaggaaaaaacagaggagtcggagaaatgatgaggagctggagacaagagcccacagagtagctactgaagaaaggggccggaagccccaccaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctccccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaatggtagaggaccgagcacagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgactaga

SEQ ID NO: 162 - protein, 377 aa, Homo sapiens
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPGGSILGQSNGLSAWTPPSHPTSLPFAEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 163 - DNA, 1144 bp, Mus musculus
gcctcaccacagtcctgacagaaagaactcagagtcacccctgggaaaagaactctaaagatgaaatgtaaattcctgggtagcttctttctgctcttcagcctttccggcaaaggggcggactgcagagacaatgagaccatctggggtgtcttgggtcatggcatcaccctgaacatccccaactttcaaatgactgatgatattgatgaggtgcgatgggtaaggaggggcaccctggtcgcagagtttaaaaggaagaagccaccttttttgatatcagaaacgtatgaggtcttagcaaacggatccctgaagataaagaagccgatgatgagaaacgacagtggcacctataatgtaatggtgtatggcacaaatgggatgactaggctggagaaggacctggacgtgaggattctggagagggtctcaaagcccatgatccactgggaatgccccaacacaaccctgacctgtgcggtcttgcaagggacagattttgaactgaagctgtatcaaggggaaacactactcaatagtctcccccagaagaacatgagttaccagtggaccaacctgaacgcaccattcaagtgtgaggcgataaacccggtcagcaaggagtctaagatggaagttgttaactgtccagagaaaggtctgtccttctatgtcacagtgggggtcggtgcaggaggactcctcttggtgctcttggtggcgctttttattttctgtatctgcaagaggagaaaacggaacaggaggagaaaagatgaagagctggaaataaaagcttccagaacaagcactgtggaaaggggccccaagccgcactcaaccccagccgcagcagcgcagaattcagtggcgctccaagctcctcctccacctggccatcacctccagacacctggccatcgtcccttgcctccaggccaccgtacccgtgagcaccagcagaagaagagacctcctccatcaggcacacagattcaccagcagaaaggccctcctttacccagaccccgagttcagccaaaacctccctgtgggagtggagatggtgtttcactgccgccccctaattaagaaggcagagttcgtcatttccaataaaaagctgtgtggatttatcttc

SEQ ID NO: 164 - protein, 344 aa, Mus musculus
MKCKFLGSFFLLFSLSGKGADCRDNETIWGVLGHGITLNIPNFQMTDDIDEVRWVRRGTLVAEFKRKKPPFLISETYEVLANGSLKIKKPMMRNDSGTYNVMVYGTNGMTRLEKDLDVRILERVSKPMIHWECPNTTLTCAVLQGTDFELKLYQGETLLNSLPQKNMSYQWTNLNAPFKCEAINPVSKESKMEVVNCPEKGLSFYVTVGVGAGGLLLVLLVALFIFCICKRRKRNRRRKDEELEIKASRTSTVERGPKPHSTPAAAAQNSVALQAPPPPGHHLQTPGHRPLPPGHRTREHQQKKRPPPSGTQIHQQKGPPLPRPRVQPKPPCGSGDGVSLPPPN

SEQ ID NO: 165 - DNA, 1086 bp, Homo sapiens; identical to SEQ ID NO: 145

SEQ ID NO: 166 - protein, 250 aa, Homo sapiens; identical to SEQ ID NO: 146

SEQ ID NO: 167 - DNA, 1097 bp, Homo sapiens
ctttttctagccaggctctcaactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattgtcaattaactgaa

SEQ ID NO: 168 - protein, 243 aa, Homo sapiens
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARSFGVEWIASWLVVTVPTILGLLLT

SEQ ID NO: 169 - DNA, 1205 bp, Mus musculus
atacgacttccggttttgggttttgcttcctgattgaagggcaggcgccctgacttctcttacagttgtctccagtgttctggggaagcttctctaagtattatgtgcttcataaaacagggatggtgtctggtcctggaactgctactgctgcccttgggaactggatttcaaggtcattcaataccagatataaatgccaccaccggcagcaatgtaaccctgaaaatccataaggacccacttggaccatataaacgtatcacctggcttcatactaaaaatcagaagattttagagtacaactataatagtacaaagacaatcttcgagtctgaatttaaaggcagggtttatcttgaagaaaacaatggtgcacttcatatctctaatgtccggaaagaggacaaaggtacctactacatgagagtgctgcgtgaaactgagaacgagttgaagataaccctggaagtatttgatcctgtgcccaagccttccatagaaatcaataagactgaagcgtcgactgattcctgtcacctgaggctatcgtgtgaggtaaaggaccagcatgttgactatacttggtatgagagctcgggacctttccccaaaaagagtccaggatatgtgctcgatctcatcgtcacaccacagaacaagtctacattttacacctgccaagtcagcaatcctgtaagcagcaagaacgacacagtgtacttcactctaccttgtgatctagccagatcttctggagtatgttggactgcaacttggctagtggtcacaacactcatcattcacaggatcctgttaacctgacaagaactcttctcacccaagaaggcaacttggaagcacagagtcttgccttcatccctagcagtgttcctagccagcgaagcaactctggctctattggacaaaggaaaatgtgttactgaacgtctgcgagagtttgcatgcatgctctatgaaacaagcacaggaccttgtacagtgctccaccactgacctgtgtgcccagtcctttacaaagatttcaaatcaaccttttaaaaactgtgcataatatctaattttatataccctagttgtttcccaacatatattaaagataaatgcattctttttaccaaaatgtgactatattattttcatgttttcatatctctttttaaaataaattcttttaaaaaact

SEQ ID NO: 170 - protein, 240 aa, Mus musculus
MCFIKQGWCLVLELLLLPLGTGFQGHSIPDINATTGSNVTLKIHKDPLGPYKRITWLHTKNQKILEYNYNSTKTIFESEFKGRVYLEENNGALHISNVRKEDKGTYYMRVLRETENELKITLEVFDPVPKPSIEINKTEASTDSCHLRLSCEVKDQHVDYTWYESSGPFPKKSPGYVLDLIVTPQNKSTFYTCQVSNPVSSKNDTVYFTLPCDLARSSGVCWTATWLVVTTLIIHRILLT

SEQ ID NO: 171 - DNA, 12123 bp, Homo sapiens
gcagatgggaagaagcgttagagcgagcagcactcacatctcaagaaccagcctttcaaacagtttccagagatggattatcctactttacttttggctcttcttcatgtatacagagctctatgtgaagaggtgctttggcatacatcagttccctttgccgagaacatgtctctagaatgtgtgtatccatcaatgggcatcttaacacaggtggagtggttcaagatcgggacccagcaggattccatagccattttcagccctactcatggcatggtcataaggaagccctatgctgagagggtttactttttgaattcaacgatggcttccaataacatgactcttttctttcggaatgcctctgaagatgatgttggctactattcctgctctctttacacttacccacagggaacttggcagaaggtgatacaggtggttcagtcagatagttttgaggcagctgtgccatcaaatagccacattgtttcggaacctggaaagaatgtcacactcacttgtcagcctcagatgacgtggcctgtgcaggcagtgaggtgggaaaagatccagccccgtcagatcgacctcttaacttactgcaacttggtccatggcagaaatttcacctccaagttcccaagacaaatagtgagcaactgcagccacggaaggtggagcgtcatcgtcatccccgatgtcacagtctcagactcggggctttaccgctgctacttgcaggccagcgcaggagaaaacgaaaccttcgtgatgagattgactgtagccgagggtaaaaccgataaccaatataccctctttgtggctggagggacagttttattgttgttgtttgttatctcaattaccaccatcattgtcattttccttaacagaaggagaaggagagagagaagagatctatttacagagtcctgggatacacagaaggcacccaataactatagaagtcccatctctaccagtcaacctaccaatcaatccatggatgatacaagagaggatatttatgtcaactatccaaccttctctcgcagaccaaagactagagtttaagcttattcttgacatgagtgcattagtaatgactcttatgtactcatgcatggatctttatgcaatttttttccactacccaaggtctaccttagatactagttgtctgaattgagttactttgataggaaaaatacttcattacctaaaatcatttttcatagaactgtttcagaaaacctgactctaactggtttatatacaaaagaaaacttactgtatcatataacagaatgatccaggggagattaagctttgggcaagggctatttaccagggcttaaatgttgtgtctagaattaagtatgggcataaactggcttctgaatccctttccagagtgttggatccatttccctggtcttggcctcactctcatgcaggctttcctcttgtgttggcaagatggctgccaactcttggcaattcatacatccttgtttctgtctggtagagagtttgcttctcaaatggagcaaacaaatttgattattttttcattgttaaataggcaacatgaccagaaaggatggaatggcttaagtaaactaagggttcacttctagagctgagaagcagggtcaaagcacaatactgggcaattcagagcatggttagaagaggaaaggggagtctcaaagctggagagtttaccaacaaatattgactgcagtgattaaccaagacatttttgttaactaaaaagtgaaatatgggatggattctagaaatggggtatctctgtccatacttctagaatccactctatcagcatagtccagaagaatacctggcagtagaagaaatgaatattcaagaggaagataaatgcgagagggcaatcctttactattctcatatttatttatctctcattctgtatagaattcttgccgccatcccaggtctagccttaggagcaaatgtagtagatagtcgaataataaataacttaatgttttggacatattttgtctacttttgagaattatttttaatatgtaaattctctcaaaagggtcaggcacctagttattattttttaatgattatgtgaaagttgaatataatataccactaaaagtgacagttgaaagtggtggcataggacggtagggtagaaatttgggagggaaaaaagaaattgggagggtacaggcaacaggagaaaggaatcaaaccacagaaaaatacaaagggaaacttctgcttcactattcagacaaagacagccctaatgacatcaccaacagtcaaagcaattagagaccatacctaatattgtttaaattctagatgtaggctaacaatgaaaagtatttgccaaactgaataaaactgtcatggttaccttgaaaggacaatggttattgttaaatatagtgatcattcatgtctaaaagattcattatttatctctaaagatttctaaagaccaccatctagaaaagattcattatgaaggctgtatttaaatatcaaagttgtggacttcatgataatcttaaataaagcaaatccaaattctcctgttgcctagacagattctaagatgtaatttacacttttaagctaattagtgagtattttatgattttagccttaaacaccatgtatgccaaataatgcacttgttttgtgaattacagaaatggtaagtgcccacatttctgtgaattataaaatttgtgagtttcttttaacccttttcaggagtgaaaaaataaaaacgaccatttcctggttgtgcttaagtatatgcaagaagggtaaactctcatttttattatgtttgcttaaagatctttttatacctggattcatgaaatgtttccacaaatatattagtgtaacaaacttgaaaggcagtttacaagaaagcactctactatcagatcaatcaaagattctgtgagtgaatttattggtttgcatggtgaagcaagcttagcatcaattaaaaggtaaataatttcttttctgaatggtaaagacaatcaaaatattactttctggaaaactccaataaccaaattctcaatgattagtgtatgtgagcaggaaaacatttttacagttgtagtatggggaaatataaatccaattttaagagagaaaattatgactgggtgtggaagggacagtatagtcagataccattgtcatggtggtttttactgggaacttcatgaaagacttttgtagcaaaccactgcagtattgcaaagcctccagaacatttggaacttgtctctttttccttgtgtgtgtttgtgtttttggtctctcattcaaaatattgatgagaactatttactctgtcctttcttctctatatattcttcctctacagagtgtagggttttttcaggaatttggagccatctgaagtcctcccaaaaattctctgacgtcttctgatgctcctgttataccctcaggggtaatgcttgtgaaattccattcattcattttctttctctggacatctttacttaccaaagcactttcattgtcatctttttaacatcattcttaattcgtgatagttttgggactctccctagtgtatgtttctccccctctactcttttgcacctatgattctgattgttactaagaaagcagatgaaaaacagatccacagaataaacgatcagaattccagtaaattctattttaaatacagatactttttacaagttgctgctttggaagcaaaatgcttcttaagttttacatatatatatatatatatacatatatatatacacatataatttatatcgatggataatacattaagaatctatgcttcctttgaatgccattaatatttatgttaaagtaaccaatgaaaggaaattactttgttataataagataggaagacttgttaatggagtacacagttttgtcagggaaagaacacatcttattgaactatgatgactatgcattgactatattattataagagataccttcaaactttatttaaagaactttaggtataatatgttgagaaaataaaatagaaatttcatttacttgtaatcatgcttaaaatgggaggcaggtaggtgaagatataatttttagtaaaaactccaatttatgttttaagtaattcagtgtattactaaaatactatatatataaacttaaaatacatgggttatcaatttaaaagacaaagtaagtaaaaatacttttagtaggcattcgtggattgtgaacatccaagttatattggtttgtatagaatggcattaagtaaaaattacagctgtataacagtagttttctaaattgagagagtccacattgtaattagagatcactgtgaccaaaatgcttctccttgatttataatgatgtactgtattttgtactgcttatatgaaatttcagcaagattgacgatattataaagatgcttataaagtgtaagtggagacgctaaattgtgagtacaaagtttctttttcacaacagtgataagaaaatatctttaaaaaatataagacaatataaacatgtcatcattagtttagctactattaaaatgtaacatctagaaagtactgatctccaccttcagacttctgtataagtatattttttcactgatctgttcattagagttcttccagccaagactctgggctcttaaaacatgtatctgaaaactaaaaacaagttaatttttttaaaagcttctctatttctagtgattcaataggtagaaaaatagcttctagaattaactgcaatgctttctaaggaaattttataaatcctcaaggtcggtttacacatatttttccagattcagagcactaactatcttgtaagatgtaagaaaaggtccatttggaagtatgagtaataaatgtctgggataattctggtttatttcgtattatccttgttagaataagttatatggtcaacctgttcagaacactttttctagtgttagtgtgtacttttggatttttggttcttgtagggtatagaaatattttcctttgtcttgtattctgttgttttgaatgaataaaacacaatgtttcacgatcactactttcatttgccatggagaaatagcagggaaaaatttctacagaataaaattaactgatgaattacatgcagaaaaaattcaaatcaatgatacattgtaatttttatctcaatgcaatgttctttgtattttattttattattatttttttgagacggagtttcacttttgttgcccgggctggagtgcaatggcacaatctcggctcaccacaacctctgcctcccggattcaagtgattctcctgcctcagcctcctgaatagctgggattacaggcatatgccaacatgcctggctaattttgtatttttagtggagacggggtttctccacgttggtcagacttgtcttgaactctggacctcaggtgatccacctgcctcagcctcctaaattgctgggattacaggcatgagcgaccactcctggccttgttctttgtattttataagtgcatgtagtgcaaagggtcaaagggctttacaggttttttgtttgtttgtttttgtttttcccgaaacatagtagtcccttgcccttcctcatttttgttaccttgagacaacaaattttactacttctaactcattattttatttatgttcacttttctgaatagcatgcttatgacactaatactttttttttcaattttagacattcattattcatttagatgtctttctctccccaaactcaccacataaaatactcttctcatgtctctttcagaaatatttgtattaaaatatgattatatcaatatttggcatttatttcttatgaccttgccagtactcttagttaaactacatggtaaaaatgattttgctttccctcctacataactttttttccacctagagctaataattgtcattctggggactgactttttctgtatttaccataaattgacctgaaactcccctgtgatgcagcaggaattctaccaacgtcaacttccttagaaagactccattagaagcttgacttggggctagaaggagaggcacacaactgccatcctggtgtctcccttcatccagaaaaagggggaggaatacatgaaacctagaatccactctaaaacattttccagaacaaaaggacatgtgtttccgtgttgtaaatgtttaacgagtgcccataacaaggaataataagtctattatgtttgcttttgtgtctgtaaaagttgggggtattggttgtaagcacgaaaacagatactgactgttgaagaaaaaaaaaaatacgaggtcaggagtttgagaccaacttggccaatatggtgaaaccctgtcttagtaaaaatagaaaaattagccaggcctggtggcacgcacctgtagtcccagctacttgggaggctgaggcagaagaatcgcttgaacccgggaggcagaggttgcagtgagccaagatcgcaccactgcactccaccctgggcaacagagcgagactccgtctcaaaaaaaaaaaaaaaaaaaaaaaaaaaaagttaagtatttgaacataggggtggctcatagaattcccaggacacccgatggagtaggcttgcaaaacacaacatgtggcaactccagtgggaaacgaggcaggaaacactcgtttcctgcagaaagcaacaatttgggcttcgataccctccctagaacacagggcagtgaatctgagcagcatcagtaccccacgttcggatgagtcctgagcccctatttttattcactgacttattccaaaatcagtgtctcttaaatatatctggaaggcagcagcttgtatctcccccttcagcttccatagtggcagtcagggtacaacttactttccaaacagaacacactgcgacattccctccaggctcgttgaagaacttcaactgacaaatgtccctcctcgaccagatgatagttttcttaaaggcagggtttaatatacccttttataaatgtttcaaggccctgtgtaatacctgagtttattccagatgtaactaaatatatccaagattgttttaaaataaattgctgaaaaaacaaataaatacagttagtatctatatcaatattctcagttggcagttttgcaataatggccgatagttcatttttagtaacactattgacattgcatttggatattagggtttactaatcatccgcatgtatacattgcatatttttctagactttaactttattcaaatctattgatttttaaacctgcaacttatgtctagacacaggtatacctttacaagaactaccattttttttggtaacatactacctccaaaatttcaagtaagaagttgatttttgtccatttttaaatggaaaacttgtaatcaaaatgccacaaaattatactgtgtatcatttgacctatagaaaccaatattattacaggaagaaagcagagccaatcttctacctgtggtcaaataagtggaggccctttctagactaagttctcatgagtttaaaataccaagcataagttctccaaattcctgaaaaggaagccttgtgttgtattgcccagccatatttgtaagacataaaaataaaacttgagaagaagctatgataacttactttcttcattcttcaaaatttacataatctcaactgattttatgtttttatgaaaatgcattcttaagatatatccttattcaatcatgtattcattacatcctttatgccaggtatccaaaagtacttacagtgactaagaccattattctttgatcagctgcctgagtaagactttgagctctccaatatactctcagtgatactaagttttctgagtaacagctttggatgtggcttcagttgagctgatttatcccacactttatttttatcgtataatggtcctcagaagcaaattttgattttagctcacataaaaaatgtacaaagaaatgtaatggctcagtagcttctagagatagagattactcttctaacctttctgtaattttgtatgtctattttataattctttcaatgtctaatgaatagctatctttttttgagacggagtctcgctctgtcgcccaggctggagtgcagtggtgcgacctcggctcaccgcaagctgcgtcttccaggttcacgccattctcctgcctcagcctcccgagtagctgggacttcaggcgcccaccaccatgcccagctaatttttttgtatttttagtagagacggggtttcaccgtgttagccagggtggtctcgatctcctgacctcgtgatccgcccgcctcggcctcccaacgtgctgggattacaggagtgagccaccgcgcccggcctccttagtttcttaaggtggaagcctagattattgattttatatgttgttttcttttccaatagtggcacttaatgctataaatttcactttgttccacaagttttggtaagctctatttttattttcatttagtccaaaatattttaaaatttcttttgatatttcttctttgagccatgaattatttacaatgtgttgtttaatctctatatattttgggatttttctactttatatctcttacagatttctaacttaatttcatcatgttttaaaaacattctttgtataatttctattcttttaaatttttcaggtgtattttatggcccagaatatggtctatcttgtagaatgtttcatgtgatcttaagaagaatgttcattctgctgttgagtgtaatattctacaaatgtccattagattaaactgattgataccaccgttcagattatctatatcctttctgattttccctcttcttgatctatcacatactgacagatcaagtgatcaagtctcgttaaagactgcaagtaaaatagtggatttttctatttctccttgcagttttgttagtttttgtctcatgtatcttgatactcttgttagtacatatactttcagaatcgttaggttttcttggagaattgacccctttaccacatgtaatgtcccttttattcttgataatctttcttgttctgtctgctttttctgatattaacataactttcagttttttaaaaaattaacattagcatctcacatctttatccttttaattttaaattatctaaatatttatatttaatgtgcctttcttatagacaatgtatagttgcgtctatttgtaatttccccacttttcttacttaaaaatgttgtagatatataggagttgtatatatttggggggtacatgtgatgttttgatacctgtatacaatatgtaatgatcatattgggtaatcgtgatatctgtcacctctaacattcatcttttttgtgtgtttaaacccaccacttctaattggtacatttagattattcaaatttaagtgattattgatatagttggattaatatctactatgtttgtaacttttctatccttgcactcgttctttcttttttatcctcctttttctgtgttctctgattttaactggggtttttacatgatttaattttctctcgtggcatatctttcattgatcaacctaggtttttctccttttcccctcttttttttggtatttattctatttagtgttatctgagctacctgagttggtgtctatcactaattttggcaagttcccagacgttattacttctaacattcttttgctccattctttcttcttcttcaattattccatagtcttgaatattctgggtttttcccactctttgaattttagtttgaaaagtttctattggcctagcttcaaagtcattcattcttccttcggggttccaagtcaactgataattgcatcaaagatatccttcctttctattactatgttttttattgctaccatttcttttttattccttcttagtgtttccatctttcttcttacattatccatctgttgtctatttttttcatgagagctcttaacatattaatgataagttccatgtctgataattctgacacgtgtcatgtctctatctggttccaatgattgctttatctcttcagaccatgacttttcttgccttttgacgttctttgacattttttttgaattttttgttgcaagccagatctggtgtgttatgtaataggaacaggtaaataagtctttagcttgcagacttatcttaatctgactaactattagactgtgtttaaagtctgttataaccataggtgctaaatttcttcaaattcctctagtgtctttgttttgtttgttcatgtgtttttccccttcttgagttcaggcttccctaagtgctcctcttcagagagactttctgtctttcagctctttcctctgcaattcactgttactatactggagccctgttggtgtagtactaagctgtgggaaaggagagtgctctgtaatcttacagtgaaatctcagtcttttagtgggtctgtgtctgggacattcacagagcttctccagtggtattgcttcctcatcctcaactctctttcctggctgcagcattcccaatgtatttctttgaaggcctgccccctgttgactgttattttccctctttccttaagtgggacagggagacttcaggggctgggatgaggtttgggaattgtgcttggcagagtcctttccatctttgttaccaagaaggttcatggcttatttctcaatggatgtccctctctatctgttgccagagccacgaggaaatttttcttggatcctcataatgagaaccttggagtttcctactggaaaagcccttgaatgtgtggagtgcctcaagagcacagcccccatgggtttcttgctcacaccagtccacaaacagatgccagcaattcacccaacttaccatataaaggctcatactagtttatggctccagtgctttgactccagataaatggctattggttgcgtatctctctggatgtatctgtatctccagattttggggtggcagtttgctcaggaccttggttctctaataggtctaataagaaaagtcattgattttcagctttccaactttccagctttgtcttgttataagcatggcagcaacatcttccatgccttaacatgatgacactaaaggcagaagtcgatctccatgtataaacattttaacacatatgttttttgttatcgtggtttctgacctgtctctttgccctgactttctgatactgcactagggttcctgttgctggactccattccatatgacttgctctcgtctaggctgctctttggctcatctttataaatcatgatccaaaatgaagcacatatttattttttaaataaatatgaaatgaagtatagacatcaaactgaagatgagtagatcatactgagtttcactgtctgtgcttggatcaacatcaggccttatacaaatattcaagtccagaggcaaaaggtaataaggaaaatttgtagcacaagccacaaggagataacatgtcaagtctatgcgattggaaataaactaaagatgaactgctggggatgctcactcatcacagagctcagtctaaagcaccagatttcacaagcattttttgggggaaattctgttaaaatgaaatatgagtcacatggtggtgtttcactcatcatatgtgttcaatattaattcattttaaggtttagttgcacaaaaggtaaatgagaattagaagactccatgggtaagaggagccacagaagtaaagcattgtcaagggttctatgtctatatatttagatattaggcttctgagaaaaaaacacaataggaaggaagatgaacacaacagagggcagaaggtctatacgtcctgaggccttttatgcaacgtttgtttgtggaatgttttttaagaatgtgtgagagtcattttaatgtgaaataaagacctacgtctaca

SEQ ID NO: 172 - protein, 336 aa, Homo sapiens
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 173 - DNA, 2487 bp, Mus musculus
acacagaagacttcttgacttcaggagacactgctgtatgaaacagtgcttgctatcagtggctgctggaagaggctgtggtggaaagaaaacctcaactgcaggccagagttggttccccaaaagaggcaaactcccagtgctagccagaggctaggaagctctaagcaacccacttatctgcaaggagagttacgcccaaagagcatcaagtccaacctcctgaactgtttccagagatggcttatgttacttggcttttggctattcttcatgtgcacaaagcactgtgtgaagagacattgtgggacacaacagttcggctttctgagactatgactctggaatgtgtatatccattgacgcataacttaacccaggtggagtggaccaagaacactggcacaaagacagtgagcatagcagtttacaaccctaaccataatatgcatatagaatctaactacctccatagagtacacttcctaaactcaacagtggggttccgcaacatgagcctttccttttacaatgcctcagaagcagacattggcatctactcctgcttgtttcatgctttcccaaatggaccttgggaaaagaagataaaagtagtctggtcagatagttttgagatagcagcaccctcggatagctacctgtctgcagaacctggacaagatgtcacactcacttgccagcttccaaggacttggccagtgcaacaagtcatatgggaaaaagtccagccccatcaggtagacatcttagcttcctgtaacctatctcaagagacaagatacacttcaaagtacctaagacaaacaaggagcaactgtagccaggggagcatgaagagcatcctcatcattccaaatgccatggccgctgactcaggactttacagatgtcgctcagaggccattacaggaaaaaacaagtcctttgtcataaggctgatcataactgatggtggaaccaataaacattttatccttcccatcgttggagggttagtttcactgttacttgtcatcctaattatcatcattttcattttatataacaggaagagacggagacaggtgagaattccacttaaagagcccagggataaacagagtaaggtagccaccaactgcagaagtcctacttctcccatccagtctacagatgatgaaaaagaggacatttatgtaaactatccaactttctctcgaagaccaaaaccaagactctaagctgctcttttggcctgaacacattagtgatgacttctatggcatggaattttacccatgatttccttaccactaggatctacattgataaaaaaaattgattaaatttatttcatctcatatatagaagtactttattacctggaaacattcttaatagagattcattagaaaacccaaatctaatgttcatgtgttcaaggaaccttcttccattatgtaacagaacagtctagagaagattaaggaccacatggctttcttgctctacttgaaattaattgtgagcataagcttgtttctggagtcttcttacattgttggttctacttacatactactggtccaactctcatgctgtttctctcagatgttcccatgatggttgccaaggacacttgatagaaagactactggttaaacacaataaacaaagttcattattcacttattagcaagaaggtagcattatcataaaggattagatgacttaagttagctataggttcaagacctggactaaagtattacttggaaattctgagtattgctaaaaaggaggatgaaagggacctagaagttgagttattactaaaaactttgagtgcgaagatattactcattaaccagataacaagtgaatatgctgtagcatcaacataattcaaaagagtaaagaaatggctaggaatgaggtagttgtgtaattatttcttctcttactagtttcaaataaattcatctctaattctatagagaattcttgcctcccattcaggactggccttctatacagtgagatggtccagtaagaaataatttttattagtgttttttctattttgagaattattttaatatatattttaatatataaacttgtgagttaaattttttttttgcaaaattagcacatgaaaagagattgatggttttaagtagtagaacacagtagtgtaggaatctgagagcagagagtttgggagggggtgaagagaaaacaacatcaccaaatagtgatatataagagaaaatctgtgcttcagagtttgatcagggccatctctcccaactctgctggaactgagagaatgcacctgatgttgtctccattttagatagagaaaaaaaaaacccgaatatttataaaactaaataaaactatagttacctcaaaactatggggatcactataacatagaatagaatagaatagaatagaatagaatagaatagaatagaatag

SEQ ID NO: 174 - protein, 333 aa, Mus musculus
MAYVTWLLAILHVHKALCEETLWDTTVRLSETMTLECVYPLTHNLTQVEWTKNTGTKTVSIAVYNPNHNMHIESNYLHRVHFLNSTVGFRNMSLSFYNASEADIGIYSCLFHAFPNGPWEKKIKVVWSDSFEIAAPSDSYLSAEPGQDVTLTCQLPRTWPVQQVIWEKVQPHQVDILASCNLSQETRYTSKYLRQTRSNCSQGSMKSILIIPNAMAADSGLYRCRSEAITGKNKSFVIRLIITDGGTNKHFILPIVGGLVSLLLVILIIIIFILYNRKRRRQVRIPLKEPRDKQSKVATNCRSPTSPIQSTDDEKEDIYVNYPTFSRRPKPRL

SEQ ID NO: 175 - DNA, 1968 bp, Homo sapiens
gaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaacggcttcttggcgtttctgcggggctggggtgttaagtggactggacttttctcgagggattcgaaggggacgggaatcttgtcaccccgggatctggcacccatggtggagtccagtgtggccttagctcccaagcctgcccctcccgagtccactctggctcaattaccccgagaaggagagagcaagtcgcggccacagcgagtgagtgaaccggagcccagatgagagcgctttaatggggctgcgaggtggcggagacagggtcgggatggggtgcagcagttggagacacagggtcagggcccctcatcctctattcactccaccggggcagtgaaagggtcccggcagcgagtgggtc

SEQ ID NO: 176 - protein, 417 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 177 - DNA, 1611 bp, Mus musculus
ctgcgtggaggggaaatgggccagaggctgctggcagggggcctcctctgctgtacacaagctggttttgtagacagtgagagggaagctgatcccagtcccctaaccctgttctgcccaggagcctgagaactgagcttactcgggcaaatgctagggcttcagaaatggaggagctgcctaggagggagaggtcacctcctggggcagccacaccagggtcaactgcacgtgttctccagcctctgttcctaccactgctgctgctgctgctgctgctgcttggtggccagggccagggcggcatgtctggcaggtgtgactgtgccagtgagtcccagaagaggtatggcccgttttgttgcaggggctgcccaaagggacactacatgaaggccccctgcgcagaaccctgtggcaactccacctgccttccctgtccctcggacaccttcttgaccagagacaaccactttaagactgactgtacccgctgccaagtctgtgatgaagaggcccttcaagtgacccttgagaactgctcggcaaagtcggacacccactgtggctgccagtcaggctggtgtgttgactgctccaccgagccatgtgggaaaagctcacctttctcttgtgtcccatgcggggctacaacaccagtccatgaggctccaacccccctgttttgggtccaggtgcttctaggagtcgcgttcctttttggggctatcctgatctgtgcatattgtcgatggcagccttgtaaggccgtggtcactgcagacacagctgggacggagaccctggcctcaccacagactgcccatctctcagcctcagacagcgcccacaccctcctggcacctccaagcagtactgggaaaatctgtaccactgtccagttggtaggcaacaactggacccctggcttatcccagactcaggaggtggtctgcggacaggcctcacaaccctgggatcagctgccaaacagaactcttggaactcctctggcatctccgctctcgccagcgccccctgcgggctctccggctgctgtgctccagcctggcccgcagctctacgatgtgatggatgcggtcccagcacgaaggtggaaggagttcgtgcgcacgctggggctgcgggaagcggaaattgaagccgtggaggtggaaatctgccgcttccgagaccagcagtatgagatgctcaagcgctggcgtcagcagcagcctgcaggcctcggtgccatctatgcggctctggagcgcatgggtctggaaggctgtgccgaggacctgcgcagccgcctgcagcgtggcccgtgatggaaggtccatcagccactttgacaccctagtgacccttgaaggagccttaagtattgttacttatgcgtgtagacattttatgtcaattactaaccccctgccgtggtcctgcgtagcagggctggctgcctcacttttgcttatctgcagcacggagctcctgctaagggaagcgtcatggagaaataccagaaggggccaagtgattggttgctcagctgttaattagcccgagtttggacttggtattaaatttcgtaagaaaagcagctgcttg

SEQ ID NO: 178 - protein, 387 aa, Mus musculus
MEELPRRERSPPGAATPGSTARVLQPLFLPLLLLLLLLLGGQGQGGMSGRCDCASESQKRYGPFCCRGCPKGHYMKAPCAEPCGNSTCLPCPSDTFLTRDNHFKTDCTRCQVCDEEALQVTLENCSAKSDTHCGCQSGWCVDCSTEPCGKSSPFSCVPCGATTPVHEAPTPLFWVQVLLGVAFLFGAILICAYCRWQPCKAVVTADTAGTETLASPQTAHLSASDSAHTLLAPPSSTGKICTTVQLVGNNWTPGLSQTQEVVCGQASQPWDQLPNRTLGTPLASPLSPAPPAGSPAAVLQPGPQLYDVMDAVPARRWKEFVRTLGLREAEIEAVEVEICRFRDQQYEMLKRWRQQQPAGLGAIYAALERMGLEGCAEDLRSRLQRGP

SEQ ID NO: 179 - DNA, 1140 bp, Homo sapiens
ggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaa

SEQ ID NO: 180 - protein, 300 aa, Homo sapiens
MRALEGPGLSLLCLVLALPALLPVPAVRGVAETPTYPWRDAETGERLVCAQCPPGTFVQRPCRRDSPTTCGPCPPRHYTQFWNYLERCRYCNVLCGEREEEARACHATHNRACRCRTGFFAHAGFCLEHASCPPGAGVIAPGTPSQNTQCQPCPPGTFSASSSSSEQCQPHRNCTALGLALNVPGSSSHDTLCTSCTGFPLSTRVPGAEECERAVIDFVAFQDISIKRLQRLLQALEAPEGWGPTPRAGRAALQLKLRRRLTELLGAQDGALLVRLLQALRVARMPGLERSVRERFLPVH

SEQ ID NO: 181 - DNA, 1805 bp, Homo sapiens
agcagtcagcaacagggtcccgtccttgacacctcagcctctacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccgccgccaccactgcctccactaccgctgccacccctgaagaagagagggaaccacagcacaggcctgtgtctccttgtgatgtttttcatggttctggttgccttggtaggattgggcctggggatgtttcagctcttccacctacagaaggagctggcagaactccgagagtctaccagccagatgcacacagcatcatctttggagaagcaaataggccaccccagtccaccccctgaaaaaaaggagctgaggaaagtggcccatttaacaggcaagtccaactcaaggtccatgcctctggaatgggaagacacctatggaattgtcctgctttctggagtgaagtataagaagggtggccttgtgatcaatgaaactgggctgtactttgtatattccaaagtatacttccggggtcaatcttgcaacaacctgcccctgagccacaaggtctacatgaggaactctaagtatccccaggatctggtgatgatggaggggaagatgatgagctactgcactactgggcagatgtgggcccgcagcagctacctgggggcagtgttcaatcttaccagtgctgatcatttatatgtcaacgtatctgagctctctctggtcaattttgaggaatctcagacgtttttcggcttatataagctctaagagaagcactttgggattctttccattatgattctttgttacaggcaccgagaatgttgtattcagtgagggtcttcttacatgcatttgaggtcaagtaagaagacatgaaccaagtggaccttgagaccacagggttcaaaatgtctgtagctcctcaactcacctaatgtttatgagccagacaaatggaggaatatgacggaagaacatagaactctgggctgccatgtgaagagggagaagcatgaaaaagcagctaccaggtgttctacactcatcttagtgcctgagagtatttaggcagattgaaaaggacaccttttaactcacctctcaaggtgggccttgctacctcaagggggactgtctttcagatacatggttgtgacctgaggatttaagggatggaaaaggaagactagaggcttgcataataagctaaagaggctgaaagaggccaatgccccactggcagcatcttcacttctaaatgcatatcctgagccatcggtgaaactaacagataagcaagagagatgttttggggactcatttcattcctaacacagcatgtgtatttccagtgcaattgtaggggtgtgtgtgtgtgtgtgtgtgtgtgtgtgtgtatgactaaagagagaatgtagatattgtgaagtacatattaggaaaatatgggttgcatttggtcaagattttgaatgcttcctgacaatcaactctaatagtgcttaaaaatcattgattgtcagctactaatgatgttttcctataatataataaatatttatgtagatgtgcatttttgtgaaatgaaaacatgtaataaaaagtatatgttaggatacaaataa

SEQ ID NO: 182 - protein, 281 aa, Homo sapiens
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 183 - DNA, 1935 bp, Mus musculus
tgaggcttctcagcttcagatgcaagtgagtgggtgtctcacagagaagcaaagagaagagaacaggagaaaggtgtttcccttgactgcggaaactttataaagaaaacttagcttctctggagcagtcagcgtcagagttctgtccttgacacctgagtctcctccacaaggctgtgagaaggaaaccctttcctggggctgggtgccatgcagcagcccatgaattacccatgtccccagatcttctgggtagacagcagtgccacttcatcttgggctcctccagggtcagtttttccctgtccatcttgtgggcctagagggccggaccaaaggagaccgccacctccaccaccacctgtgtcaccactaccaccgccatcacaaccactcccactgccgccactgacccctctaaagaagaaggaccacaacacaaatctgtggctaccggtggtatttttcatggttctggtggctctggttggaatgggattaggaatgtatcagctcttccacctgcagaaggaactggcagaactccgtgagttcaccaaccaaagccttaaagtatcatcttttgaaaagcaaatagccaaccccagtacaccctctgaaaaaaaagagccgaggagtgtggcccatttaacagggaacccccactcaaggtccatccctctggaatgggaagacacatatggaaccgctctgatctctggagtgaagtataagaaaggtggccttgtgatcaacgaaactgggttgtacttcgtgtattccaaagtatacttccggggtcagtcttgcaacaaccagcccctaaaccacaaggtctatatgaggaactctaagtatcctgaggatctggtgctaatggaggagaagaggttgaactactgcactactggacagatatgggcccacagcagctacctgggggcagtattcaatcttaccagtgctgaccatttatatgtcaacatatctcaactctctctgatcaattttgaggaatctaagacctttttcggcttgtataagctttaaaagaaaaagcattttaaaatgatctactattctttatcatgggcaccaggaatattgtcttgaatgagagtcttcttaagacctattgagattaattaagactacatgagccacaaagacctcatgaccgcaaggtccaacaggtcagctatccttcattttctcgaggtccatggagtggtccttaatgcctgcatcatgagccagatggaaggaggtctgtgactgagggacataaagctttgggctgctgtgtgacaatgcagaggcacagagaaagaactgtctgatgttaaatggccaagagaattttaaccattgaagaagacacctttacactcacttccagggtgggtctacttactacctcacagaggccgtttttgagacatagttgtggtatgaatatacaagggtgagaaaggaggctcatttgactgataagctagagactgaaaaaaagacagtgtctcattggcaccatctttactgttacctaatgttttctgagccgacctttgatcctaacggagaagtaagagggatgtttgaggcacaaatcattctctacatagcatgcatacctccagtgcaatgatgtctgtgtgtttgtatgtatgagagcaaacagattctaaggagtcatataaataaaatatgtacattatggagtacatattagaaacctgttacatttgatgctagatatctgaatgtttcttggcaataaactctaatagtcttcaaaatcttttattatcagctactgatgctgtttttctttaatacaactagtatttatgctctgaacatcctaatgaggaaaagacaaataaaattatgttatagaatacagaaatgccttaaggacatagactttggaaa

SEQ ID NO: 184 - protein, 279 aa, Mus musculus
MQQPMNYPCPQIFWVDSSATSSWAPPGSVFPCPSCGPRGPDQRRPPPPPPPVSPLPPPSQPLPLPPLTPLKKKDHNTNLWLPVVFFMVLVALVGMGLGMYQLFHLQKELAELREFTNQSLKVSSFEKQIANPSTPSEKKEPRSVAHLTGNPHSRSIPLEWEDTYGTALISGVKYKKGGLVINETGLYFVYSKVYFRGQSCNNQPLNHKVYMRNSKYPEDLVLMEEKRLNYCTTGQIWAHSSYLGAVFNLTSADHLYVNISQLSLINFEESKTFFGLYKL

SEQ ID NO: 185 - DNA, 1713 bp, Homo sapiens
gaccaggagtcagtttggcggttatgtgtggggaagaagctgggaagtcaggggctgtttctgtggacagctttccctgtcctttggaaggcacagagctctcagctgcagggaactaacagagctctgaagccgttatatgtggtcttctctcatttccagcagagcaggctcatatgaatcaaccaactgggtgaaaagataagttgcaatctgagatttaagacttgatcagataccatctggtggagggtaccaaccagcctgtctgctcattttccttcaggctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgctaaaactggctcaatccttctgatcattgcagttttctctcaaatatgaacactttataattgtatgttctttttagaccccataaatcctgtatacatcaaagagaa

SEQ ID NO: 186 - protein, 364 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKKYFFKKEVQQLSVSFSSLQIKALQNAVEKEVQAEDNIYIENSLYATD

SEQ ID NO: 187 - DNA, 1909 bp, Mus musculus
gtcagtaccatgaatcagattcaagtcttcatttcaggcctcatactgcttctcccaggcgctgtggattcttatgtggaagtaaagggggtggtgggtcaccctgtcacacttccatgtacttactcaacatatcgtggaatcacaacgacatgttggggccgagggcaatgcccatcttctgcttgtcaaaatacacttatttggaccaatggacatcgtgtcacctatcagaagagcagtcggtacaacttaaaggggcatatttcagaaggagatgtgtccttgacgatagagaactctgttgagagtgacagtggtctgtattgttgtcgagtggagattcctggatggtttaatgatcagaaagtgaccttttcattgcaagttaaaccagagattcccacacgtcctccaagaagacccacaactacaaggcccacagctacaggaagacccacgactatttcaacaagatccacacatgtaccaacatcaaccagagtctctacctccactcctccaacatctacacacacatggactcacaaaccagaacccactacattttgtccccatgagacaacagctgaggtgacaggaatcccatcccatactcctacagactggaatggcactgtgacatcctcaggagatacctggagtaatcacactgaagcaatccctccagggaagccgcagaaaaaccctactaagggcttctatgttggcatctgcatcgcagccctgctgctactgctccttgtgagcaccgtggctatcaccaggtacatacttatgaaaaggaagtcagcatctctaagcgtggttgccttccgtgtctctaagattgaagctttgcagaacgcagcggttgtgcattcccgagctgaagacaacatctacattgttgaagatagaccttgaggggcagaatgagtaccagtggccctctgagggaccttctgcctgagatttatagagactgtcactgatgtcatagagtcacacccattacagcgccaaggcgattttctgtgttggttcttccagctgcagcagagagggtaaccctctactgtgtatactcaaaactcagattaacatcatcctaattttggtatctgcaccacctccgtgtctctgctcactacagagattctctcaaacatgaacgttttagaagtttgtgtttcccttagtcaatgtaatcattggtaatactattctattcttggttactaaaaccattactaagagagggataggaattaaaagttggtgtgaggggcctcctgaatttagaagcacttgattctgttttatctactttcttgaaatgttacttctacccttcccaatgggtaaaatcatgggagcatggtgccctcatagataaatagaagagagtctattgctgccaatatagatggttatgctttctcatagctctgaaaatatgacacatttattatgaggttgatcttaggataaggataggtgttttatgtcaggagaggttatcatggtgaatatggaccagcagacagcagtggaggaaaataatgaaccaagggattgagttcattagtgctaattctactccactcctgtctttatgctcctaaacttactgactgagctctgaattaggtgctaggaggagacaatgcagacatgaaaggggaaggagcgccttcaggacacaggctctctgctgagagaagtcctatttgcaggtgtgatagaggttgggacaatctctgagttgtaaatttctaattgtcttcaggccatatttatagttaaattcatttccgaaagacatagcatcttccccaatgggtcagtttgtcaaaatcaataaaatattttgttttgctaagaattaaaaaaaaaaaaaaaaaaa

SEQ ID NO: 188 - protein, 305 aa, Mus musculus
MNQIQVFISGLILLLPGAVDSYVEVKGVVGHPVTLPCTYSTYRGITTTCWGRGQCPSSACQNTLIWTNGHRVTYQKSSRYNLKGHISEGDVSLTIENSVESDSGLYCCRVEIPGWFNDQKVTFSLQVKPEIPTRPPRRPTTTRPTATGRPTTISTRSTHVPTSTRVSTSTPPTSTHTWTHKPEPTTFCPHETTAEVTGIPSHTPTDWNGTVTSSGDTWSNHTEAIPPGKPQKNPTKGFYVGICIAALLLLLLVSTVAITRYILMKRKSASLSVVAFRVSKIEALQNAAVVHSRAEDNIYIVEDRP

SEQ ID NO: 189 - DNA, 2097 bp, Homo sapiens
gctcacctccgcctgagcagtggagaaggcggcactctggtggggctgctccaggcatgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattataattaaatatgagagcatgctaa

SEQ ID NO: 190 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 191 - DNA, 1933 bp, Mus musculus
tgagcagcggggaggaggaagaggagactgctactgaaggcgacactgccaggggctctgggcatgtgggtccggcaggtaccctggtcattcacttgggctgtgctgcagttgagctggcaatcagggtggcttctagaggtccccaatgggccctggaggtccctcaccttctacccagcctggctcacagtgtcagagggagcaaatgccaccttcacctgcagcttgtccaactggtcggaggatcttatgctgaactggaaccgcctgagtcccagcaaccagactgaaaaacaggccgccttctgtaatggtttgagccaacccgtccaggatgcccgcttccagatcatacagctgcccaacaggcatgacttccacatgaacatccttgacacacggcgcaatgacagtggcatctacctctgtggggccatctccctgcaccccaaggcaaaaatcgaggagagccctggagcagagctcgtggtaacagagagaatcctggagacctcaacaagatatcccagcccctcgcccaaaccagaaggccggtttcaaggcatggtcattggtatcatgagtgccctagtgggtatccctgtattgctgctgctggcctgggccctagctgtcttctgctcaacaagtatgtcagaggccagaggagctggaagcaaggacgacactctgaaggaggagccttcagcagcacctgtccctagtgtggcctatgaggagctggacttccagggacgagagaagacaccagagctccctaccgcctgtgtgcacacagaatatgccaccattgtcttcactgaagggctgggtgcctcggccatgggacgtaggggctcagctgatggcctgcagggtcctcggcctccaagacatgaggatggacattgttcttggcctctttgaccagattcttcagccattagcatgctgcagaccctccacagagagcaccggtccgtccctcagtcaagaggagcatgcaggctacagttcagccaaggctcccagggtctgagctagctggagtgacagcccagcgcctgcaccaattccagcacatgcactgttgagtgagagctcacttcaggtttaccacaagctgggagcagcaggcttcccggtttcctattgtcacaaggtgcagagctggggcctaagcctatgtctcctgaatcctactgttgggcacttctagggacttgagacactatagccaatggcctctgtgggttctgtgcctggaaatggagagatctgagtacagcctgctttgaatggccctgtgaggcaaccccaaagcaagggggtccaggtatactatgggcccagcacctaaagccacccttgggagatgatactcaggtgggaaattcgtagactgggggactgaaccaatcccaagatctggaaaagttttgatgaagacttgaaaagctcctagcttcgggggtctgggaagcatgagcacttaccaggcaaaagctccgtgagcgtatctgctgtccttctgcatgcccaggtacctcagtttttttcaacagcaaggaaactagggcaataaagggaaccagcagagctagagccacccacacatccaggggggcacttgactctccctactcctcctaggaaccaaaaggacaaagtccatgttgacagcagggaaggaaagggggatataaccttgacgcaaaccaacactggggtgttagaatctcctcattcactctgtcctggagttgggttctggctctccttcacacctaggactctgaaatgagcaagcacttcagacagtcagggtagcaagagtctagctgtctggtgggcacccaaaatgaccagggcttaagtccctttcctttggtttaagcccgttataattaaatggtaccaaaagctttaa

SEQ ID NO: 192 - DNA, 696 bp, Artificial Sequence
  Description of Artificial Sequence: Synthetic polynucleotide
atggtgagcaagggcgaggcagtgatcaaggagttcatgcggttcaaggtgcacatggagggctccatgaacggccacgagttcgagatcgagggcgagggcgagggccgcccctacgagggcacccagaccgccaagctgaaggtgaccaagggtggccccctgcccttctcctgggacatcctgtcccctcagttcatgtacggctccagggccttcaccaagcaccccgccgacatccccgactactataagcagtccttccccgagggcttcaagtgggagcgcgtgatgaacttcgaggacggcggcgccgtgaccgtgacccaggacacctccctggaggacggcaccctgatctacaaggtgaagctccgcggcaccaacttccctcctgacggccccgtaatgcagaagaagacaatgggctgggaagcgtccaccgagcggttgtaccccgaggacggcgtgctgaagggcgacattaagatggccctgcgcctgaaggacggcggccgctacctggcggacttcaagaccacctacaaggccaagaagcccgtgcagatgcccggcgcctacaacgtcgaccgcaagttggacatcacctcccacaacgaggactacaccgtggtggaacagtacgaacgctccgagggccgccactccaccggcggcatggacgagctgtacaag

SEQ ID NO: 193 - protein, 232 aa, Artificial Sequence
  Description of Artificial Sequence: Synthetic polypeptide
MVSKGEAVIKEFMRFKVHMEGSMNGHEFEIEGEGEGRPYEGTQTAKLKVTKGGPLPFSWDILSPQFMYGSRAFTKHPADIPDYYKQSFPEGFKWERVMNFEDGGAVTVTQDTSLEDGTLIYKVKLRGTNFPPDGPVMQKKTMGWEASTERLYPEDGVLKGDIKMALRLKDGGRYLADFKTTYKAKKPVQMPGAYNVDRKLDITSHNEDYTVVEQYERSEGRHSTGGMDELYK

SEQ ID NO: 194 - DNA, 3861 bp, Artificial Sequence
  Description of Artificial Sequence: Synthetic polynucleotide
ggcctaactggcctcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgggcctcggcggccaagcttggcaatccggtactgttggtaaagccaccatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgtaattctagagtcggggcggccggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataaggatccgtcgaccgatgcccttgagagccttcaacccagtcagctccttccggtgggcgcggggcatgactatcgtcgccgcacttatgactgtcttctttatcatgcaactcgtaggacaggtgccggcagcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagcggccgcaaatgctaaaccactgcagtggttaccagtgcttgatcagtgaggcaccgatctcagcgatctgcctatttcgttcgtccatagtggcctgactccccgtcgtgtagatcactacgattcgtgagggcttaccatcaggccccagcgcagcaatgatgccgcgagagccgcgttcaccggcccccgatttgtcagcaatgaaccagccagcagggagggccgagcgaagaagtggtcctgctactttgtccgcctccatccagtctatgagctgctgtcgtgatgctagagtaagaagttcgccagtgagtagtttccgaagagttgtggccattgctactggcatcgtggtatcacgctcgtcgttcggtatggcttcgttcaactctggttcccagcggtcaagccgggtcacatgatcacccatattatgaagaaatgcagtcagctccttagggcctccgatcgttgtcagaagtaagttggccgcggtgttgtcgctcatggtaatggcagcactacacaattctcttaccgtcatgccatccgtaagatgcttttccgtgaccggcgagtactcaaccaagtcgttttgtgagtagtgtatacggcgaccaagctgctcttgcccggcgtctatacgggacaacaccgcgccacatagcagtactttgaaagtgctcatcatcgggaatcgttcttcggggcggaaagactcaaggatcttgccgctattgagatccagttcgatatagcccactcttgcacccagttgatcttcagcatcttttactttcaccagcgtttcggggtgtgcaaaaacaggcaagcaaaatgccgcaaagaagggaatgagtgcgacacgaaaatgttggatgctcatactcgtcctttttcaatattattgaagcatttatcagggttactagtacgtctctcaaggataagtaagtaatattaaggtacgggaggtattggacaggccgcaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctct

SEQ ID NO: 195 - protein, 171 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 196 - DNA, 2590 bp, Homo sapiens
ctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaatttattcttaaacgtgactactttatttctaaataagaaattccctacctgcttcctacaagcagttcagaatgccatgccttggttgtcctagtgtgaataattttcagctactttaaaattatattgtactttctcaagcatgtcatatcctttcctattagagtatctatattacttgttactgatttacctgaaggcaatctgattaatttctaggtttttaccatattcttgtcatcttgccaattacattttaagtgttagactagactaagatgtactagttgtatagaatataactagatttattatggcaatgtttattttgtcattttgcttcatctgttttgttgttgaagtactttaaatttcatacgttcatggcatttcactgtaaagactttaatgtgtatttcttaaaataaaactttttttcctccttaa

SEQ ID NO: 197 - protein, 381 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 198 - protein, 128 aa, Homo sapiens
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 199 - DNA, 1936 bp, Homo sapiens
agaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacgggaa

SEQ ID NO: 200 - protein, 387 aa, Homo sapiens
MPRPRLLAALCGALLCAPSLLVALDICSKNPCHNGGLCEEISQEVRGDVFPSYTCTCLKGYAGNHCETKCVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 201 - DNA, 2221 bp, Homo sapiens
gcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagttggggtctcactgtgttgcccagactggtctcgaactcttggcctcaggtgatcctcttccctcagcttcccagaatgccgagatgatagagacggggtctgactgtgttacccaggctggtcttcaactcttggcctcaagtgatcctcctgccttagcttccaagaatgctgaggttacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 202 - protein, 630 aa, Homo sapiens
MELQPPEASIAVVSIPRQLPGSHSEAGVQGLSAGDDSELGSHCVAQTGLELLASGDPLPSASQNAEMIETGSDCVTQAGLQLLASSDPPALASKNAEVTGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 203 - DNA, 2886 bp, Homo sapiens
atcgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccagcccagcccatcagtgcagacattgcctcccgcctgctgaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataa

SEQ ID NO: 204 - protein, 801 aa, Homo sapiens
MERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSCQACGDSVLVVSEDVNYEPDLDFHQGRLYWSDLQAMFLQFLGEGRLEDTIRQTSLRERVAGSAGMAALTQDIRAALSRQKLDHVWTDTHYVGLQFPDPAHPNTLHWVDEAGKVGEQLPLEDPDVYCPYSAIGNVTGELVYAHYGRPEDLQDLRARGVDPVGRLLLVRVGVISFAQKVTNAQDFGAQGVLIYPEPADFSQDPPKPSLSSQQAVYGHVHLGTGDPYTPGFPSFNQTQFPPVASSGLPSIPAQPISADIASRLLRKLKGPVAPQEWQGSLLGSPYHLGPGPRLRLVVNNHRTSTPINNIFGCIEGRSEPDHYVVIGAQRDAWGPGAAKSAVGTAILLELVRTFSSMVSNGFRPRRSLLFISWDGGDFGSVGSTEWLEGYLSVLHLKAVVYVSLDNAVLGDDKFHAKTSPLLTSLIESVLKQVDSPNHSGQTLYEQVVFTNPSWDAEVIRPLPMDSSAYSFTAFVGVPAVEFSFMEDDQAYPFLHTKEDTYENLHKVLQGRLPAVAQAVAQLAGQLLIRLSHDRLLPLDFGRYGDVVLRHIGNLNEFSGDLKARGLTLQWVYSARGDYIRAAEKLRQEIYSSEERDERLTRMYNVRIMRVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 205 - DNA, 11158 bp, Homo sapiens
gttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattaactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaactaatctcaactgcattacattgtttctaatcaatattcagtgcttgtcttggtggaagaggtgagtcattttgaaaacttatggtcttgtttttatgtgtttttcaaagttttgaatgctaagtacctcatttattttaaaaagcctagtttaatgataagtttgtttaaaattttgagccatcatttttctcttcatagcaaataaggagagaattgacatttcagtgttacctagaaaaggaattgtaagcccagaataattccctgcatgaggtaatctgcttcaaattctttttttagtcaaggttagctataagtaatacttgttaaatgagtaaatatgtaatactttgtgaattactttgttaatttaggagcatcaaatgtatattatgtttagttatttatgaaactctcaatattgattgatttgggtaattataaattagttatttttacttgtaattgaatgcttaaattctgtttacagtccgtcctctctccctccatccctccctccccagttttataaattcaggtaccaattcacaaacaaaatcagaaataaaataaatttattgactgcttctggatttagcattccctgtagtgtcaagcaatgtcatgcagtttggggaagcatttatttaaggaaatgacaactttctctgatcagtcttgttttgtgaggtgtcttcaacactttatgctttgggtacttcgtgtttgtcacagtcttaggatagtgaaatctgatttgtccaagcggagcaaactactcgaccctcagtccttgtatttgtccctgtagtaagacctaattattattatttcttaaagatgggattggtgtccttggcaactatgaaatttcggggcttgtgcatgagaaggcatttcttattaagtatttctaattgaaggtatcagagtgtcaagcattacaaacctggacagttcacctggaggagtacaagaagagatattcattatccatatttaaagggtcaaggtttcccaaaaccagggtgcaagccagatgtagttttaaagcagctgccagggacagttcatctttagagaagtcactaaagttgtaagaaattttagtttccccaaaaccactttcaacttcttagaaactagaaagacaattggtttgccccacagaggacaacttcagtttcagcatctctcatgttgtgttcttgattaaaaacaacttccatttgatatacttttccgtttattaccagtttagttttttcactattgtttctgtattcaactctttatatgattaggatagaaatttagcccttctgttttatattactatattgtttgtgtgtcttagatatatacatgtatgtactattttcagtagaaattcatgtattttataattggtaagttcttcagagcatctcttctataaaaagcaacaggatgctaggtaaaacggagcattgagcaaaatactgattagtttttgctttttcctgaaatctacactaaagtgatagggtgtggggtaatccaacaaggacaaggtgaattgaacaagaacgaaatctggaagcagatgaaggagtactattgattgggcagacccagggaagtcaaatcctaaaccagcagtgggaacacaacagaatggtgtagtttgcactggtaagatttgggtacctggcagggctgggtgcggtggctcacacctgtaatcccagcactttgggaggccaaggcgggtggatcacttgaggtcaggagttcgagaccaccctggccaacatggtgaaaccccgtctctactaaaaatacagctgggcgtggtggcacatgcttgtaatcccagctactcgggaggcagaggcaggagatttgcttgaacccgggaggcagaggcaggagatttgcttgaacccaggaggcagaggctgcagtgagccgcgattgcgccattgcactccagcctgggtgacagagcgagactctgtctcaaaaaaaaaaaaaaaaaaaaaaaaaaaaaaaaaaaaaaaaaaaaaaaatttgagtacctggcctttgttactttttttctatgtgtgtgacaaaaacataatatgcacacttttgtaacccacctttctcatttaatggtacattgataatgtatatcacattaactactctaaatatttctgtggatgtatgtttttttttttcttaaccaatttcccattgtttggacatgtaggttccacattgtttattattttaaacaattctaaagaattttaaacaattcttaggaaaatcctcagcctaataatgaaattaattcctaaaagtggaattgttggggtaaaggttttttgagggacattgataaaaattatggtactgtctcccagatagatgtaccaagttatactaccacgatttaatatatatatatatatatattaaatcagagtcccatccttagaaatccacatatatgcagccacatgaatgtattagaaacaataatagaagactcatgcttaattcagttgattagctttagacataattcaaatgcaagtcaaattgagtgccctaattgtggtctcttaagtaccatttttcttcaagggaaccagactcctttggataaatcactaattccacctgtaagaaagaaatgtacaagaagaacctaggaaacattgttttgtaccagatcagaaagattcaggaggcaccttagaagttaccactggccaaggctgagataactttagcatcagcaaggataatatctgcaagagattgaaactcatagtattgtatttaactctgtgagttaatgatggtagtggacagaattatagttacctttgggatacgcttttaaagaaattccaggtaataagagaaatgatagaattaggatatcaccattttacccccccaacaatttatggatctagacaataatcgccagtgactgctaacctcacaaagtgagagcaatcagattttgtgcctcctaatggaagtacatataccacctatgaagcagttctgccaaaagtcacatctcatcatgatgaagcctcctgatctaactaccccttcattagaaatacaggggacagagggacaaataatatacaagggactcaatcagcaaaatccagactctggaaaactacaagacatatggtcctgcttcaacaacagaaatgcaaagagaaaagacaacgatgggttaaaggagacttaagagctacatctatcaagacaatttatggacttatttggatactgatttgaacaaactgttgagaccattggaaaaatgtgaaaagtggatatttgatattaaggtttttaattatttttaggtgtgataatggtattgttacattttttaaaggaccccttttagagatgcaaattgaaacacttaaaaaatgaaatgatacgatgtataagtttttgcttaaaaataaggattgaagttggctggtgtgtgtggatatagttgaaacaagattggctgtgagttgataattattgaagctgggtgatgggcacttggggatttattatactattttctctacctgtgtttatatttgaaatttttcatagaagttttaaaatgtggccagttgtgatggctcatacctgtaatcccaacactttgggaggccaaggtgggaggatcacttgagctcaggagttagagaccagcctgggcaaaatagtgagactccatctcaaagaaaaaaaaaaagtgttttaaatgtgaatcaaattcctatagaagctgattcattactgtttttattttagcagtaattcatgataatgacctgtattcataatgattttcataatgattgttttagtggaattaaacttgaaccagtcaagctaacataattatattctgctccagttacaatgaataattaattgatttcaactgctagggtgaactcttgaagctatcagtcatccagcaatcttagcaagcaggccattgggtccctgtttgctctgtctctctctctctctctcactgttgaagggcttagctaactacttaagtaaaatatttgttctctgttaaacatgtcaaggagtatggtcagcttatccacattaagcctgtgtgtcccacgttggagtaaatgttaagtagctcactacaataaactagattcttctgccctctcttgtttaaatgatcatgttccctggaggtggaaatagatctttaaaaagatattctgtagttgtttgttctcagtgtaaaaaaatgagaataatttgataagagtgtaggttgtcttatataaaaagtggttccatttgcatgaattttagaaaaatcattttggaaaaatgaaggctatgtggttatactgaacacattaagcaattttattctttattttaaatgaatattttattatcgttttcttcccttgccctttgggtatgggagttagcctttgtgtttctaaatacaacaggccggtttttataaattaaggtgtcaatatattcttcattatttagttttgtgattgtggttagttttcatttttcttaagtatctgctagtagcatctgtaattaagtgaagtgacctgttaaccattttcctctttctcctcctttcctcctccttgaaacatatcagagcatgtttgaaattctttggcttttatggtatgcatttgctgatatgcattgaccagttaccttactcacagatacttcttaggcacttgattgtgccagggccttggctagatgataagaatacagtagtgaacttaacagtttccctgccctggtgaagcgtatggtcttgtaggtgagatagatatcagataatcatgtgaataaatgtacaattccagctgtgatacatgctgaggaggaggtttttggtgatccaagagctgatcatgcagagataggactgagaaaggagggtgggacgttgtcacagctgataatgcagagataggactgagaaaggagggtgggacatcaggaaggtcagagaattccttatgaaagtgatgcttgagtcaaaatatgatggatgaagagagtttaaatagattacatagaatttttaataatgtcgattggttatatactgggcactgatagctgatttttctttggggaaaggtatgtcagcctagtcattcagattcctttatttttttaaatgttttttcattttttgctttgcattgcattcatttgctgaagagctggcttgtactttggcaggtgtcatacttggttattctccttaggatattggcccaacaatctgggagttgtgaaaggcgcttcgcttttcagacctgggcgtctgtatcatgactatcataaatttaggattaagacacctagcctcctaccaggatgaatgaggtgtccatgtgacctgctgtgccctggaattttatacatctttctctcatagcacacaccatattacaatataatcctgcctcatctaagccaaactttcgagagaatcatttacactcagtggctacttcagctcccattcacttatcaacctgctgcaatttttcacagcccccaaaggactgcagtctgtgccttcagggagctgagggtctagcggaaggaaagaaaccagcagttacagtacagaggggtttgtgttggaaactctacaaacacaggatgccctggtagctcagaggaagtgcatatcgagcatggtaggtaggtagtgggaagagccaagatgacttcccagaggagaaaagctggacctgagttttggagtttcggtaaaagtttgctctaactagtccaagctgctgtcacaagcttttagaaatgatgtaaccatggggcagttgactgtcgtcatgttctttgctattttcatgactctggatgtgcttttcctattccctggattgccctttccctcgattcctctgcaggactgggctttattaatctccatttccttgagcttggctatagtaggtgttcaataaacatttgttttgttgtgtgctttgtaaataggcaatgaagctgatttcacaagataggcacaaaagttagtttcattacaacacattaccaacagctgtatttttaacttttaacatatctcattctaaatcctgtggcagcacaacctccttccgtcatacctggagataaattttctttcaaaatctaatatgcactgtatttatagaatatgaaacataccgaccatgttttgcaaaaatgggaaaggcataacttagctttggggcatgtaagtaacaactcctgataggagaagaaatgtattcagaaagctcaaattagaaataaaatgggagactcta

SEQ ID NO: 206 - protein, 748 aa, Homo sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 207 - DNA, 1225 bp, Homo sapiens
agccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctgga

SEQ ID NO: 208 - protein, 228 aa, Homo sapiens
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 209 - DNA, 1847 bp, Homo sapiens
agtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaa

SEQ ID NO: 210 - protein, 279 aa, Homo sapiens
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 211 - DNA, 5306 bp, Homo sapiens
ctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 212 - protein, 188 aa, Homo sapiens [sequence omitted]

SEQ ID NO: 213 - DNA, 42 bp, Artificial Sequence
  Description of Artificial Sequence: Synthetic oligonucleotide
aaaaagaagaaaaagaagaagaagacaaagtgtgtaattatg

SEQ ID NO: 214 - protein, 14 aa, Artificial Sequence
  Description of Artificial Sequence: Synthetic peptide
KKKKKKKKTKCVIM

SEQ ID NO: 215 - DNA, 4296 bp, Homo sapiens
gcacttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgatggggtcacaatggggaaattgaagtggtgcataacattgccaaaatagtgtgccactagaaatggtgtaaaggctgtcttttttttttttttaaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtacaaatttgttgtgtttttttatgttctaataatactgagacttctaggtcttaggttaatttttaggaagatcttgcatgccatcaggagtaaattttattgtggttcttaatctgaagttttcaagctctgaaattcataatccgcagtgtcagattacgtagaggaagatcttacaacatttccatgtcaaatctgttaccatttattggcatttagttttcatttaagaattgaacataattatttttattgtagctatatagcatgtcagattaaatcatttacaacaaaaggggtgtgaacctaagactatttaaatgtcttatgagaaaatttcataaagccattctcttgtcattcaggtccagaaacaaattttaaactgagtgagagtctatagaatccatactgcagatgggtcatgaaatgtgaccaaatgtgtttcaaaaattgatggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatccttttttttttttttttttgaaagtgtgttagcatcttgttactcaaaggataagacagacaataatacttcactgaatcttaataatctttactagtttacctcctctgctctttgccacccgataactggatatcttttccttcaaaggaccctaaactgattgaaatttaagatatgtatcaaaaacattatttcatttaatgcacatctgttttgctgtttttgagcagtgtgcagtttagggttcatgataaatcattgaaccacatgtgtaacaactgaatgccaaatcttaaactcattagaaaaataacaaattaggttttgacacgcattcttaattggaataatggatcaaaaatagtggttcatgaccttaccaaacacccttgctactaataaaatcaaataacacttagaagggtatgtatttttagttagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatgaaatttgacgtatcttttcatccaaagttttgtacatcatgttttctaacggaaaaaaatgttaatatggcttttttgtattactaaaaatagctttgagattaaggaaaaataaataactcttgtacagttcagtattgtctattaaatctgtattggcagtatgtataatggcatttgctgtggttacaaaatacttcctctgggttataataatcatttgatccaattcctattgcttgtaaaataaagttttaccagttgatataatcaa

SEQ ID NO: 216 - protein, 332 aa, Homo sapiens
MGAQFSKTAAKGEAAAERPGEAAVASSPSKANGQENGHVKVNGDASPAAAESGAKEELQANGSAPAADKEEPAAAGSGAASPSAAEKGEPAAAAAPEAGASPVEKEAPAEGEAAEPGSPTAAEGEAASAASSTSSPKAEDGATPSPSNETPKKKKKRFSFKKSFKLSGFSFKKNKKEAGEGGEAEAPAAEGGKDEAAGGAAAAAAEAGAASGEQAAAPGEEAAAGEEGAAGGDPQEAKPQEAAVAPEKPPASDETKAAEEPSKVEEKKAEEAGASAAACEAPSAAGPGAPPEQEAAPAEEPAAAAASSACAAPSQEAQPECSPEAPPAEAAE

SEQ ID NO: 217 - DNA, 24 bp, Artificial Sequence
  Description of Artificial Sequence: Synthetic oligonucleotide
atgggttgctgtttctccaagacc

SEQ ID NO: 218 - protein, 8 aa, Artificial Sequence
  Description of Artificial Sequence: Synthetic peptide
MGCCFSKT

SEQ ID NO: 219 - DNA, 2079 bp, Artificial Sequence
  Description of Artificial Sequence: Synthetic polynucleotide
atgtacaggatgcaactcctgtcttgcattgcactaagtcttgcacttgtcacgaactcgatatcggccatggttagatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaagccagcggaagtggcggaggaggcggtcctggagaaggtgcctatgtataccgctcagcattcagtgtgggattggagacttacgttactatccccaacatgcccattcgctttaccaagatcttctacaatcagcaaaaccactatgatggctccactggtaaattccactgcaacattcctgggctgtactactttgcctaccacatcacagtctatatgaaggatgtgaaggtcagcctcttcaagaaggacaaggctatgctcttcacctatgatcagtaccaggaaaataatgtggaccaggcctccggctctgtgctcctgcatctggaggtgggcgaccaagtctggctccaggtgtatggggaaggagagcgtaatggactctatgctgataatgacaatgactccaccttcacaggctttcttctctaccatgacaccaactctagaaagcttcctggagaaggtgcctatgtataccgctcagcattcagtgtgggattggagacttacgttactatccccaacatgcccattcgctttaccaagatcttctacaatcagcaaaaccactatgatggctccactggtaaattccactgcaacattcctgggctgtactactttgcctaccacatcacagtctatatgaaggatgtgaaggtcagcctcttcaagaaggacaaggctatgctcttcacctatgatcagtaccaggaaaataatgtggaccaggcctccggctctgtgctcctgcatctggaggtgggcgaccaagtctggctccaggtgtatggggaaggagagcgtaatggactctatgctgataatgacaatgactccaccttcacaggctttcttctctaccatgacaccaacactagtcctggagaaggtgcctatgtataccgctcagcattcagtgtgggattggagacttacgttactatccccaacatgcccattcgctttaccaagatcttctacaatcagcaaaaccactatgatggctccactggtaaattccactgcaacattcctgggctgtactactttgcctaccacatcacagtctatatgaaggatgtgaaggtcagcctcttcaagaaggacaaggctatgctcttcacctatgatcagtaccaggaaaataatgtggaccaggcctccggctctgtgctcctgcatctggaggtgggcgaccaagtctggctccaggtgtatggggaaggagagcgtaatggactctatgctgataatgacaatgactccaccttcacaggctttcttctctaccatgacaccaactaa

SEQ ID NO: 220 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 221 - DNA, 27 bp, Artificial Sequence
  Description of Artificial Sequence: Synthetic oligonucleotide
gctactaacttcagcctgctgaagcag

SEQ ID NO: 222 - protein, 17 aa, Artificial Sequence
  Description of Artificial Sequence: Synthetic peptide
ATNFSLKQAGDVENPGP

SEQ ID NO: 223 - DNA, 1290 bp, Artificial Sequence
  Description of Artificial Sequence: Synthetic polynucleotide
atggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacatcgatgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaatcgatccaaataaaggaagtggaaccacttcaggtactacccgtcttctatctgggcacacgtgtttcacgttgacaggtttgcttgggacgctagtaaccatgggcttgctgacttag

SEQ ID NO: 224 - protein, 429 aa, Artificial Sequence
  Description of Artificial Sequence: Synthetic polypeptide
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDIDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKIDPNKGSGTTSGTTRLLSGHTCFTLTGLLGTLVTMGLLT

SEQ ID NO: 225 - DNA, 828 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggccaaataaaggaagtggaaccacttcaggtactacccgtcttctatctgggcacacgtgtttcacgttgacaggtttgcttgggacgctagtaaccatgggcttgctgacttag

SEQ ID NO: 226 - protein, 275 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERPNKGSGTTSGTTRLLSGHTCFTLTGLLGTLVTMGLLT

SEQ ID NO: 227 - DNA, 1518 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggatcgatgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttag

SEQ ID NO: 228 - protein, 505 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERIDVEPLGMENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQIFPGNWDNHSHKKNLFETPILARYVRILPVAWHNRIALRLELLGC

SEQ ID NO: 229 - DNA, 1521 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggatcgatgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaatcgatccaaataaaggaagtggaaccacttcaggtactacccgtcttctatctgggcacacgtgtttcacgttgacaggtttgcttgggacgctagtaaccatgggcttgctgacttag

SEQ ID NO: 230 - protein, 506 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERIDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKIDPNKGSGTTSGTTRLLSGHTCFTLTGLLGTLVTMGLLT

SEQ ID NO: 231 - DNA, 1464 bp, Artificial Sequence
  Description of Artificial Sequence: Synthetic polynucleotide
atgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaactatcgatgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttag

SEQ ID NO: 232 - protein, 487 aa, Artificial Sequence
  Description of Artificial Sequence: Synthetic polypeptide
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTIDVEPLGMENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQIFPGNWDNHSHKKNLFETPILARYVRILPVAWHNRIALRLELLGC

SEQ ID NO: 233 - DNA, 1467 bp, Artificial Sequence
  Description of Artificial Sequence: Synthetic polynucleotide
atgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaactatcgatgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaatcgatccaaataaaggaagtggaaccacttcaggtactacccgtcttctatctgggcacacgtgtttcacgttgacaggtttgcttgggacgctagtaaccatgggcttgctgacttag

SEQ ID NO: 234 - protein, 488 aa, Artificial Sequence
  Description of Artificial Sequence: Synthetic polypeptide
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTIDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKIDPNKGSGTTSGTTRLLSGHTCFTLTGLLGTLVTMGLLT

SEQ ID NO: 235 - DNA, 930 bp, Artificial Sequence
  Description of Artificial Sequence: Synthetic polynucleotide
atgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtggcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataa

SEQ ID NO: 236 - protein, 309 aa, Artificial Sequence
  Description of Artificial Sequence: Synthetic polypeptide
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 237 - DNA, 1515 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaagggagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagggtcctcaccgtcctgcaccaggactggctgaacggtaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggaggacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctccgggtaaaccaaataaaggaagtggaaccacttcaggtactacccgtcttctatctgggcacacgtgtttcacgttgacaggtttgcttgggacgctagtaaccatgggcttgctgacttag

SEQ ID NO: 238 - protein, 504 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERESKYGPPCPSCPAPEFLGGPSVFLFPPKPKDTLMISRTPEVTCVVVDVSQEDPEVQFNWYVDGVEVHNAKTKPREEQFNSTYRVVRVLTVLHQDWLNGKEYKCKVSNKGLPSSIEKTISKAKGQPREPQVYTLPPSQEEMTKNQVSLTCLVKGFYPSDIAVEWESNGQPEDNYKTTPPVLDSDGSFFLYSRLTVDKSRWQEGNVFSCSVMHEALHNHYTQKSLSLSPGKPNKGSGTTSGTTRLLSGHTCFTLTGLLGTLVTMGLLT

SEQ ID NO: 239 - DNA, 1941 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggccaaataaaggaagtggaaccacttcaggtactacccgtcttctatctgggcacacgtgtttcacgttgacaggtttgcttgggacgctagtaaccatgggcttgctgactggaagcggagctactaacttcagcctgctgaagcaggctggcgacgtggaggagaaccctggacctatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaattccaaataaaggaagtggaaccacttcaggtactacccgtcttctatctgggcacacgtgtttcacgttgacaggtttgcttgggacgctagtaaccatgggcttgctgacttag

SEQ ID NO: 240 - protein, 646 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERPNKGSGTTSGTTRLLSGHTCFTLTGLLGTLVTMGLLTGSGATNFSLLKQAGDVEENPGPMAKVFSFILVTTALTMGREISALEDCAQEQMRLRAQVRLLETRVKQQQVKIKQLLQENEVQFLDKGDENTVIDLGSKRQYADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVIPNKGSGTTSGTTRLLSGHTCFTLTGLLGTLVTMGLLT

SEQ ID NO: 241 - DNA, 729 bp, Artificial Sequence
  Description of Artificial Sequence: Synthetic polynucleotide
atgggttgctgtttctccaagaccggctcgagcggcgtgagcaagggcgaggcagtgatcaaggagttcatgcggttcaaggtgcacatggagggctccatgaacggccacgagttcgagatcgagggcgagggcgagggccgcccctacgagggcacccagaccgccaagctgaaggtgaccaagggtggccccctgcccttctcctgggacatcctgtcccctcagttcatgtacggctccagggccttcaccaagcaccccgccgacatccccgactactataagcagtccttccccgagggcttcaagtgggagcgcgtgatgaacttcgaggacggcggcgccgtgaccgtgacccaggacacctccctggaggacggcaccctgatctacaaggtgaagctccgcggcaccaacttccctcctgacggccccgtaatgcagaagaagacaatgggctgggaagcgtccaccgagcggttgtaccccgaggacggcgtgctgaagggcgacattaagatggccctgcgcctgaaggacggcggccgctacctggcggacttcaagaccacctacaaggccaagaagcccgtgcagatgcccggcgcctacaacgtcgaccgcaagttggacatcacctcccacaacgaggactacaccgtggtggaacagtacgaacgctccgagggccgccactccaccggcggcatggacgagctgtacaag

SEQ ID NO: 242 - protein, 243 aa, Artificial Sequence
  Description of Artificial Sequence: Synthetic polypeptide
MGCCFSKTGSSGVSKGEAVIKEFMRFKVHMEGSMNGHEFEIEGEGEGRPYEGTQTAKLKVTKGGPLPFSWDILSPQFMYGSRAFTKHPADIPDYYKQSFPEGFKWERVMNFEDGGAVTVTQDTSLEDGTLIYKVKLRGTNFPPDGPVMQKKTMGWEASTERLYPEDGVLKGDIKMALRLKDGGRYLADFKTTYKAKKPVQMPGAYNVDRKLDITSHNEDYTVVEQYERSEGRHSTGGMDELYK

SEQ ID NO: 243 - DNA, 549 bp, Artificial Sequence
  Description of Artificial Sequence: Synthetic polynucleotide
atgggttgctgtttctccaagaccggctcgagcggcgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgtaa

SEQ ID NO: 244 - protein, 182 aa, Artificial Sequence
  Description of Artificial Sequence: Synthetic polypeptide
MGCCFSKTGSSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 245 - DNA, 849 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccaggtaatattctgaatgtgtccattaaaatatgtctaacactgtcccctagcaccccaaataaaggaagtggaaccacttcaggtactacccgtcttctatctgggcacacgtgtttcacgttgacaggtttgcttgggacgctagtaaccatgggcttgctgacttag

SEQ ID NO: 246 - protein, 282 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPGNILNVSIKICLTLSPSTPNKGSGTTSGTTRLLSGHTCFTLTGLLGTLVTMGLLT

SEQ ID NO: 247 - DNA, 939 bp, Artificial Sequence
  Description of Artificial Sequence: Synthetic polynucleotide
atggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtccgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataa

SEQ ID NO: 248 - protein, 311 aa, Artificial Sequence
  Description of Artificial Sequence: Synthetic polypeptide
MERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSACPWAVSGARASPGSAASPRLRGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 249 - DNA, 741 bp, Artificial Sequence
  Description of Artificial Sequence: Synthetic polynucleotide
atgggctgctgcggggctgtgcaggagtcccagtgcatgctgggactgttcttcggcttcctcttggtgatattcgccattgaaatagctgcggccatctggggatattcccacaaggatgaggcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataa

SEQ ID NO: 250 - protein, 246 aa, Artificial Sequence
  Description of Artificial Sequence: Synthetic polypeptide
MGCCGAVQESQCMLGLFFGFLLVIFAIEIAAAIWGYSHKDEACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 251 - DNA, 963 bp, Artificial Sequence
  Description of Artificial Sequence: Synthetic polynucleotide
atgggttgctgtttctccaagaccggctcgagcggcagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtggcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataa

SEQ ID NO: 252 - protein, 320 aa, Artificial Sequence
  Description of Artificial Sequence: Synthetic polypeptide
MGCCFSKTGSSGSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 253 - DNA, 717 bp, Artificial Sequence
  Description of Artificial Sequence: Synthetic polynucleotide
atgggttgctgtttctccaagaccggctcgagcggctgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataa

SEQ ID NO: 254 - protein, 238 aa, Artificial Sequence
  Description of Artificial Sequence: Synthetic polypeptide
MGCCFSKTGSSGWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 255 - DNA, 798 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattgggctcgagcggcccaaataaaggaagtggaaccacttcaggtactacccgtcttctatctgggcacacgtgtttcacgttgacaggtttgcttgggacgctagtaaccatgggcttgctgacttag

SEQ ID NO: 256 - protein, 265 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELGSSGPNKGSGTTSGTTRLLSGHTCFTLTGLLGTLVTMGLLT

SEQ ID NO: 257 - DNA, 834 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccaggtaatattctgaatgtgtccattaaaatatgtctaacactgtcccctagcaccttctacacaggagtctatattctgatcggagccggcgccctcatgatgctggtgggcttcctgggctgctgcggggctgtgcaggagtcccagtgctag

SEQ ID NO: 258 - protein, 277 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPGNILNVSIKICLTLSPSTFYTGVYILIGAGALMMLVGFLGCCGAVQESQC

SEQ ID NO: 259 - DNA, 876 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccaggtaatattctgaatgtgtccattaaaatatgtctaacactgtcccctagcaccttctacacaggagtctatattctgatcggagccggcgccctcatgatgctggtgggcttcctgggctgctgcggggctgtgcaggagtcccagtgcaaaaagaagaaaaagaagtcaaagacaaagtgtgtaattatgtaa

SEQ ID NO: 260 - protein, 291 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPGNILNVSIKICLTLSPSTFYTGVYILIGAGALMMLVGFLGCCGAVQESQCKKKKKKSKTKCVIM

SEQ ID NO: 261 - DNA, 837 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccaggtaatattctgaatgtgtccattaaaatatgtctaacactgtcccctagcaccatcggcgcagtgggcatcggcattgccgtggtcatgatatttggcatgatcttcagtatgatcttgtgctgtgctatccgcaggaaccgcgagatggtctag

SEQ ID NO: 262 - protein, 278 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPGNILNVSIKICLTLSPSTIGAVGIGIAVVMIFGMIFSMILCCAIRRNREMV

SEQ ID NO: 263 - DNA, 843 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccaggtaatattctgaatgtgtccattaaaatatgtctaacactgtcccctagcaccctgtacctcatcggcattgctgccatcgtggtcgctgtgatcatgatcttcgagatgatcctgagcatggtgctgtgctgtggcatccggaacagctccgtgtactga

SEQ ID NO: 264 - protein, 280 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPGNILNVSIKICLTLSPSTLYLIGIAAIVVAVIMIFEMILSMVLCCGIRNSSVY

SEQ ID NO: 265 - DNA, 1503 bp, Artificial Sequence
  Description of Artificial Sequence: Synthetic polynucleotide
atggagaggctggtgatcaggatgcccttctctcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggcatcgatgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaatcgatccaaataaaggaagtggaaccacttcaggtactacccgtcttctatctgggcacacgtgtttcacgttgacaggtttgcttgggacgctagtaaccatgggcttgctgacttag

SEQ ID NO: 266 - protein, 500 aa, Artificial Sequence
  Description of Artificial Sequence: Synthetic polypeptide
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGIDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKIDPNKGSGTTSGTTRLLSGHTCFTLTGLLGTLVTMGLLT

SEQ ID NO: 267 - DNA, 1050 bp, Artificial Sequence
  Description of Artificial Sequence: Synthetic polynucleotide
atggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaattccaaataaaggaagtggaaccacttcaggtactacccgtcttctatctgggcacacgtgtttcacgttgacaggtttgcttgggacgctagtaaccatgggcttgctgacttag

SEQ ID NO: 268 - protein, 349 aa, Artificial Sequence
  Description of Artificial Sequence: Synthetic polypeptide
MAKVFSFILVTTALTMGREISALEDCAQEQMRLRAQVRLLETRVKQQQVKIKQLLQENEVQFLDKGDENTVIDLGSKRQYADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVIPNKGSGTTSGTTRLLSGHTCFTLTGLLGTLVTMGLLT

SEQ ID NO: 269 - DNA, 1872 bp, Artificial Sequence
  Description of Artificial Sequence: Synthetic polynucleotide
atggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacaatcgatgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaatcgatccaaataaaggaagtggaaccacttcaggtactacccgtcttctatctgggcacacgtgtttcacgttgacaggtttgcttgggacgctagtaaccatgggcttgctgacttag

SEQ ID NO: 270 - protein, 623 aa, Artificial Sequence
  Description of Artificial Sequence: Synthetic polypeptide
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQTIDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKIDPNKGSGTTSGTTRLLSGHTCFTLTGLLGTLVTMGLLT

SEQ ID NO: 271 - DNA, 810 bp, Artificial Sequence
  Description of Artificial Sequence: Synthetic polynucleotide
atggagaggctggtgatcaggatgcccttctctcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggcccaaataaaggaagtggaaccacttcaggtactacccgtcttctatctgggcacacgtgtttcacgttgacaggtttgcttgggacgctagtaaccatgggcttgctgacttag

SEQ ID NO: 272 - protein, 269 aa, Artificial Sequence
  Description of Artificial Sequence: Synthetic polypeptide
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGPNKGSGTTSGTTRLLSGHTCFTLTGLLGTLVTMGLLT

SEQ ID NO: 273 - DNA, 1179 bp, Artificial Sequence
  Description of Artificial Sequence: Synthetic polynucleotide
atggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacaccaaataaaggaagtggaaccacttcaggtactacccgtcttctatctgggcacacgtgtttcacgttgacaggtttgcttgggacgctagtaaccatgggcttgctgacttag

SEQ ID NO: 274 - protein, 392 aa, Artificial Sequence
  Description of Artificial Sequence: Synthetic polypeptide
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQTPNKGSGTTSGTTRLLSGHTCFTLTGLLGTLVTMGLLT

SEQ ID NO: 275 - DNA, 720 bp, Artificial Sequence
  Description of Artificial Sequence: Synthetic polynucleotide
atggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtaccaaataaaggaagtggaaccacttcaggtactacccgtcttctatctgggcacacgtgtttcacgttgacaggtttgcttgggacgctagtaaccatgggcttgctgacttag

SEQ ID NO: 276 - protein, 239 aa, Artificial Sequence
  Description of Artificial Sequence: Synthetic polypeptide
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVPNKGSGTTSGTTRLLSGHTCFTLTGLLGTLVTMGLLT

SEQ ID NO: 277 - DNA, 774 bp, Artificial Sequence
  Description of Artificial Sequence: Synthetic polynucleotide
atgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaactccaaataaaggaagtggaaccacttcaggtactacccgtcttctatctgggcacacgtgtttcacgttgacaggtttgcttgggacgctagtaaccatgggcttgctgacttag

SEQ ID NO: 278 - protein, 257 aa, Artificial Sequence
  Description of Artificial Sequence: Synthetic polypeptide
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTPNKGSGTTSGTTRLLSGHTCFTLTGLLGTLVTMGLLT

SEQ ID NO: 279 - DNA, 951 bp, Artificial Sequence
  Description of Artificial Sequence: Synthetic polynucleotide
atgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttaatcgatccaaataaaggaagtggaaccacttcaggtactacccgtcttctatctgggcacacgtgtttcacgttgacaggtttgcttgggacgctagtaaccatgggcttgctgacttag

SEQ ID NO: 280 - protein, 316 aa, Artificial Sequence
  Description of Artificial Sequence: Synthetic polypeptide
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHLIDPNKGSGTTSGTTRLLSGHTCFTLTGLLGTLVTMGLLT

SEQ ID NO: 281 - DNA, 1413 bp, Artificial Sequence
  Description of Artificial Sequence: Synthetic polynucleotide
atggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtaatcgatgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaatcgatccaaataaaggaagtggaaccacttcaggtactacccgtcttctatctgggcacacgtgtttcacgttgacaggtttgcttgggacgctagtaaccatgggcttgctgacttag

SEQ ID NO: 282 - protein, 470 aa, Artificial Sequence
  Description of Artificial Sequence: Synthetic polypeptide
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVIDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKIDPNKGSGTTSGTTRLLSGHTCFTLTGLLGTLVTMGLLT

SEQ ID NO: 283 - DNA, 1611 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggccaaataaaggaagtggaaccacttcaggtactacccgtcttctatctgggcacacgtgtttcacgttgacaggtttgcttgggacgctagtaaccatgggcttgctgactggaagcggagctactaacttcagcctgctgaagcaggctggcgacgtggaggagaaccctggacctatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtaccaaataaaggaagtggaaccacttcaggtactacccgtcttctatctgggcacacgtgtttcacgttgacaggtttgcttgggacgctagtaaccatgggcttgctgacttag

SEQ ID NO: 284 - protein, 536 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERPNKGSGTTSGTTRLLSGHTCFTLTGLLGTLVTMGLLTGSGATNFSLLKQAGDVEENPGPMEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVPNKGSGTTSGTTRLLSGHTCFTLTGLLGTLVTMGLLT

SEQ ID NO: 285 - DNA, 1289 bp, Artificial Sequence
  Description of Artificial Sequence: Synthetic polynucleotide
atggcttgtcttggactccggaggtacaaagctcaactgcagctgccttctaggacttggccttttgtagccctgctcactcttcttttcatcccagtcttctctgaagccatacaggtgacccaaccttcagtggtgttggctagcagccatggtgtcgccagctttccatgtgaatattcaccatcacacaacactgatgaggtccgggtgactgtgctgcggcagacaaatgaccaaatgactgaggtctgtgccacgacattcacagagaagaatacagtgggcttcctagattaccccttctgcagtggtacctttaatgaaagcagagtgaacctcaccatccaaggactgagagctgttgacacgggactgtacctctgcaaggtggaactcatgtacccaccgccatactttgtgggcatgggcaacgggacgcagatttatgtcattgatccagaaccatgcccggattctgaatcgatgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaatcgatccaaataaaggaagtggaaccacttcaggtactacccgtcttctatctgggcacacgtgtttcacgttgacaggtttgcttgggacgctagtaaccatgggcttgctgacttag

SEQ ID NO: 286 - protein, 429 aa, Artificial Sequence
  Description of Artificial Sequence: Synthetic polypeptide
MACLGLRRYKAQLQLPSRTWPFVALLTLLFIPVFSEAIQVTQPSVVLASSHGVASFPCEYSPSHNTDEVRVTVLRQTNDQMTEVCATTFTEKNTVGFLDYPFCSGTFNESRVNLTIQGLRAVDTGLYLCKVELMYPPPYFVGMGNGTQIYVIDPEPCPDSDIDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKIDPNKGSGTTSGTTRLLSGHTCFTLTGLLGTLVTMGLLT

SEQ ID NO: 287 - DNA, 1518 bp, Artificial Sequence
  Description of Artificial Sequence: Synthetic polynucleotide
atgaggatatttgctggcattatattcacagcctgctgtcacttgctacgggcgtttactatcacggctccaaaggacttgtacgtggtggagtatggcagcaacgtcacgatggagtgcagattccctgtagaacgggagctggacctgcttgcgttagtggtgtactgggaaaaggaagatgagcaagtgattcagtttgtggcaggagaggaggaccttaagcctcagcacagcaacttcagggggagagcctcgctgccaaaggaccagcttttgaagggaaatgctgcccttcagatcacagacgtcaagctgcaggacgcaggcgtttactgctgcataatcagctacggtggtgcggactacaagcgaatcacgctgaaagtcaatgccccataccgcaaaatcaaccagagaatttccgtggatccagccacttctgagcatgaactaatatgtcaggccgagggttatccagaagctgaggtaatctggacaaacagtgaccaccaacccgtgagtgggaagagaagtgtcaccacttcccggacagaggggatgcttctcaatgtgaccagcagtctgagggtcaacgccacagcgaatgatgttttctactgtacgttttggagatcacagccagggcaaaaccacacagcggagctgatcatcccagaactgcctgcaacacatcctccacagaacaggactatcgatgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttag

SEQ ID NO: 288 - protein, 505 aa, Artificial Sequence
  Description of Artificial Sequence: Synthetic polypeptide
MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTIDVEPLGMENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQIFPGNWDNHSHKKNLFETPILARYVRILPVAWHNRIALRLELLGC

SEQ ID NO: 289 - DNA, 1521 bp, Artificial Sequence
  Description of Artificial Sequence: Synthetic polynucleotide
atgaggatatttgctggcattatattcacagcctgctgtcacttgctacgggcgtttactatcacggctccaaaggacttgtacgtggtggagtatggcagcaacgtcacgatggagtgcagattccctgtagaacgggagctggacctgcttgcgttagtggtgtactgggaaaaggaagatgagcaagtgattcagtttgtggcaggagaggaggaccttaagcctcagcacagcaacttcagggggagagcctcgctgccaaaggaccagcttttgaagggaaatgctgcccttcagatcacagacgtcaagctgcaggacgcaggcgtttactgctgcataatcagctacggtggtgcggactacaagcgaatcacgctgaaagtcaatgccccataccgcaaaatcaaccagagaatttccgtggatccagccacttctgagcatgaactaatatgtcaggccgagggttatccagaagctgaggtaatctggacaaacagtgaccaccaacccgtgagtgggaagagaagtgtcaccacttcccggacagaggggatgcttctcaatgtgaccagcagtctgagggtcaacgccacagcgaatgatgttttctactgtacgttttggagatcacagccagggcaaaaccacacagcggagctgatcatcccagaactgcctgcaacacatcctccacagaacaggactatcgatgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaatcgatccaaataaaggaagtggaaccacttcaggtactacccgtcttctatctgggcacacgtgtttcacgttgacaggtttgcttgggacgctagtaaccatgggcttgctgacttag

SEQ ID NO: 290 - protein, 506 aa, Artificial Sequence
  Description of Artificial Sequence: Synthetic polypeptide
MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTIDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKIDPNKGSGTTSGTTRLLSGHTCFTLTGLLGTLVTMGLLT

SEQ ID NO: 291 - DNA, 828 bp, Artificial Sequence
  Description of Artificial Sequence: Synthetic polynucleotide
atgaggatatttgctggcattatattcacagcctgctgtcacttgctacgggcgtttactatcacggctccaaaggacttgtacgtggtggagtatggcagcaacgtcacgatggagtgcagattccctgtagaacgggagctggacctgcttgcgttagtggtgtactgggaaaaggaagatgagcaagtgattcagtttgtggcaggagaggaggaccttaagcctcagcacagcaacttcagggggagagcctcgctgccaaaggaccagcttttgaagggaaatgctgcccttcagatcacagacgtcaagctgcaggacgcaggcgtttactgctgcataatcagctacggtggtgcggactacaagcgaatcacgctgaaagtcaatgccccataccgcaaaatcaaccagagaatttccgtggatccagccacttctgagcatgaactaatatgtcaggccgagggttatccagaagctgaggtaatctggacaaacagtgaccaccaacccgtgagtgggaagagaagtgtcaccacttcccggacagaggggatgcttctcaatgtgaccagcagtctgagggtcaacgccacagcgaatgatgttttctactgtacgttttggagatcacagccagggcaaaaccacacagcggagctgatcatcccagaactgcctgcaacacatcctccacagaacaggactccaaataaaggaagtggaaccacttcaggtactacccgtcttctatctgggcacacgtgtttcacgttgacaggtttgcttgggacgctagtaaccatgggcttgctgacttag

SEQ ID NO: 292 - protein, 275 aa, Artificial Sequence
  Description of Artificial Sequence: Synthetic polypeptide
MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTPNKGSGTTSGTTRLLSGHTCFTLTGLLGTLVTMGLLT

SEQ ID NO: 293 - DNA, 1464 bp, Artificial Sequence
  Description of Artificial Sequence: Synthetic polynucleotide
atgctgctcctgctgccgatactgaacctgagcttacaacttcatcctgtagcagctttattcaccgtgacagcccctaaagaagtgtacaccgtagacgtcggcagcagtgtgagcctggagtgcgattttgaccgcagagaatgcactgaactggaagggataagagccagtttgcagaaggtagaaaatgatacgtctctgcaaagtgaaagagccaccctgctggaggagcagctgcccctgggaaaggctttgttccacatccctagtgtccaagtgagagattccgggcagtaccgttgcctggtcatctgcggggccgcctgggactacaagtacctgacggtgaaagtcaaagcttcttacatgaggatagacactaggatcctggaggttccaggtacaggggaggtgcagcttacctgccaggctagaggttatcccctagcagaagtgtcctggcaaaatgtcagtgttcctgccaacaccagccacatcaggacccccgaaggcctctaccaggtcaccagtgttctgcgcctcaagcctcagcctagcagaaacttcagctgcatgttctggaatgctcacatgaaggagctgacttcagccatcattgaccctctgagtcggatggaacccaaagtccccagaacgatcgatgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttag

SEQ ID NO: 294 - protein, 487 aa, Artificial Sequence
  Description of Artificial Sequence: Synthetic polypeptide
MLLLLPILNLSLQLHPVAALFTVTAPKEVYTVDVGSSVSLECDFDRRECTELEGIRASLQKVENDTSLQSERATLLEEQLPLGKALFHIPSVQVRDSGQYRCLVICGAAWDYKYLTVKVKASYMRIDTRILEVPGTGEVQLTCQARGYPLAEVSWQNVSVPANTSHIRTPEGLYQVTSVLRLKPQPSRNFSCMFWNAHMKELTSAIIDPLSRMEPKVPRTIDVEPLGMENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQIFPGNWDNHSHKKNLFETPILARYVRILPVAWHNRIALRLELLGC

SEQ ID NO: 295 - DNA, 1467 bp, Artificial Sequence
  Description of Artificial Sequence: Synthetic polynucleotide
atgctgctcctgctgccgatactgaacctgagcttacaacttcatcctgtagcagctttattcaccgtgacagcccctaaagaagtgtacaccgtagacgtcggcagcagtgtgagcctggagtgcgattttgaccgcagagaatgcactgaactggaagggataagagccagtttgcagaaggtagaaaatgatacgtctctgcaaagtgaaagagccaccctgctggaggagcagctgcccctgggaaaggctttgttccacatccctagtgtccaagtgagagattccgggcagtaccgttgcctggtcatctgcggggccgcctgggactacaagtacctgacggtgaaagtcaaagcttcttacatgaggatagacactaggatcctggaggttccaggtacaggggaggtgcagcttacctgccaggctagaggttatcccctagcagaagtgtcctggcaaaatgtcagtgttcctgccaacaccagccacatcaggacccccgaaggcctctaccaggtcaccagtgttctgcgcctcaagcctcagcctagcagaaacttcagctgcatgttctggaatgctcacatgaaggagctgacttcagccatcattgaccctctgagtcggatggaacccaaagtccccagaacgatcgatgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaatcgatccaaataaaggaagtggaaccacttcaggtactacccgtcttctatctgggcacacgtgtttcacgttgacaggtttgcttgggacgctagtaaccatgggcttgctgacttag

SEQ ID NO: 296 - protein, 488 aa, Artificial Sequence
  Description of Artificial Sequence: Synthetic polypeptide
MLLLLPILNLSLQLHPVAALFTVTAPKEVYTVDVGSSVSLECDFDRRECTELEGIRASLQKVENDTSLQSERATLLEEQLPLGKALFHIPSVQVRDSGQYRCLVICGAAWDYKYLTVKVKASYMRIDTRILEVPGTGEVQLTCQARGYPLAEVSWQNVSVPANTSHIRTPEGLYQVTSVLRLKPQPSRNFSCMFWNAHMKELTSAIIDPLSRMEPKVPRTIDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKIDPNKGSGTTSGTTRLLSGHTCFTLTGLLGTLVTMGLLT

SEQ ID NO: 297 - DNA, 1494 bp, Artificial Sequence
  Description of Artificial Sequence: Synthetic polynucleotide
atgaggatatttgctggcattatattcacagcctgctgtcacttgctacgggcgtttactatcacggctccaaaggacttgtacgtggtggagtatggcagcaacgtcacgatggagtgcagattccctgtagaacgggagctggacctgcttgcgttagtggtgtactgggaaaaggaagatgagcaagtgattcagtttgtggcaggagaggaggaccttaagcctcagcacagcaacttcagggggagagcctcgctgccaaaggaccagcttttgaagggaaatgctgcccttcagatcacagacgtcaagctgcaggacgcaggcgtttactgctgcataatcagctacggtggtgcggactacaagcgaatcacgctgaaagtcaatgccccataccgcaaaatcaaccagagaatttccgtggatccagccacttctgagcatgaactaatatgtcaggccgagggttatccagaagctgaggtaatctggacaaacagtgaccaccaacccgtgagtgggaagagaagtgtcaccacttcccggacagaggggatgcttctcaatgtgaccagcagtctgagggtcaacgccacagcgaatgatgttttctactgtacgttttggagatcacagccagggcaaaaccacacagcggagctgatcatcccagaactgcctgcaacacatcctccacagaacaggactggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaaccaaataaaggaagtggaaccacttcaggtactacccgtcttctatctgggcacacgtgtttcacgttgacaggtttgcttgggacgctagtaaccatgggcttgctgacttag

SEQ ID NO: 298 - protein, 497 aa, Artificial Sequence
  Description of Artificial Sequence: Synthetic polypeptide
MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKPNKGSGTTSGTTRLLSGHTCFTLTGLLGTLVTMGLLT

SEQ ID NO: 299 - DNA, 774 bp, Artificial Sequence
  Description of Artificial Sequence: Synthetic polynucleotide
atgctgctcctgctgccgatactgaacctgagcttacaacttcatcctgtagcagctttattcaccgtgacagcccctaaagaagtgtacaccgtagacgtcggcagcagtgtgagcctggagtgcgattttgaccgcagagaatgcactgaactggaagggataagagccagtttgcagaaggtagaaaatgatacgtctctgcaaagtgaaagagccaccctgctggaggagcagctgcccctgggaaaggctttgttccacatccctagtgtccaagtgagagattccgggcagtaccgttgcctggtcatctgcggggccgcctgggactacaagtacctgacggtgaaagtcaaagcttcttacatgaggatagacactaggatcctggaggttccaggtacaggggaggtgcagcttacctgccaggctagaggttatcccctagcagaagtgtcctggcaaaatgtcagtgttcctgccaacaccagccacatcaggacccccgaaggcctctaccaggtcaccagtgttctgcgcctcaagcctcagcctagcagaaacttcagctgcatgttctggaatgctcacatgaaggagctgacttcagccatcattgaccctctgagtcggatggaacccaaagtccccagaacgccaaataaaggaagtggaaccacttcaggtactacccgtcttctatctgggcacacgtgtttcacgttgacaggtttgcttgggacgctagtaaccatgggcttgctgacttag

SEQ ID NO: 300 - protein, 257 aa, Artificial Sequence
  Description of Artificial Sequence: Synthetic polypeptide
MLLLLPILNLSLQLHPVAALFTVTAPKEVYTVDVGSSVSLECDFDRRECTELEGIRASLQKVENDTSLQSERATLLEEQLPLGKALFHIPSVQVRDSGQYRCLVICGAAWDYKYLTVKVKASYMRIDTRILEVPGTGEVQLTCQARGYPLAEVSWQNVSVPANTSHIRTPEGLYQVTSVLRLKPQPSRNFSCMFWNAHMKELTSAIIDPLSRMEPKVPRTPNKGSGTTSGTTRLLSGHTCFTLTGLLGTLVTMGLLT

SEQ ID NO: 301 - DNA, 1623 bp, Artificial Sequence
  Description of Artificial Sequence: Synthetic polynucleotide
atgaggatatttgctggcattatattcacagcctgctgtcacttgctacgggcgtttactatcacggctccaaaggacttgtacgtggtggagtatggcagcaacgtcacgatggagtgcagattccctgtagaacgggagctggacctgcttgcgttagtggtgtactgggaaaaggaagatgagcaagtgattcagtttgtggcaggagaggaggaccttaagcctcagcacagcaacttcagggggagagcctcgctgccaaaggaccagcttttgaagggaaatgctgcccttcagatcacagacgtcaagctgcaggacgcaggcgtttactgctgcataatcagctacggtggtgcggactacaagcgaatcacgctgaaagtcaatgccccataccgcaaaatcaaccagagaatttccgtggatccagccacttctgagcatgaactaatatgtcaggccgagggttatccagaagctgaggtaatctggacaaacagtgaccaccaacccgtgagtgggaagagaagtgtcaccacttcccggacagaggggatgcttctcaatgtgaccagcagtctgagggtcaacgccacagcgaatgatgttttctactgtacgttttggagatcacagccagggcaaaaccacacagcggagctgatcatcccagaactgcctgcaacacatcctccacagaacaggactccaaataaaggaagtggaaccacttcaggtactacccgtcttctatctgggcacacgtgtttcacgttgacaggtttgcttgggacgctagtaaccatgggcttgctgactggaagcggagctactaacttcagcctgctgaagcaggctggcgacgtggaggagaaccctggacctatggaacctctcccaggatgggggtcggcaccctggagccaggcccctacagacaacaccttcaggctggtgccttgtgtcttccttttgaacttgctgcagcgcatctctgcccagccctcatgcagacaggaggagttccttgtgggagacgagtgctgccccatgtgcaacccaggttaccatgtgaagcaggtctgcagtgagcatacaggcacagtgtgtgccccctgtcccccacagacatataccgcccatgcaaatggcctgagcaagtgtctgccctgcggagtctgtgatccagacatgggcctgctgacctggcaggagtgctccagctggaaggacactgtgtgcagatgcatcccaggctacttctgtgagaaccaggatgggagccactgttccacatgcttgcagcacaccacctgccctccagggcagagggtagagaagagagggactcacgaccaggacactgtatgtgctgactgcctaacagggaccttctcacttggagggactcaggaggaatgcctgccctggaccaactgcagtgcatttcaacaggaagtaagacgtgggaccaacagcacagacaccacctgctcctcccagccaaataaaggaagtggaaccacttcaggtactacccgtcttctatctgggcacacgtgtttcacgttgacaggtttgcttgggacgctagtaaccatgggcttgctgacttag

SEQ ID NO: 302 - protein, 540 aa, Artificial Sequence
  Description of Artificial Sequence: Synthetic polypeptide
MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTPNKGSGTTSGTTRLLSGHTCFTLTGLLGTLVTMGLLTGSGATNFSLLKQAGDVEENPGPMEPLPGWGSAPWSQAPTDNTFRLVPCVFLLNLLQRISAQPSCRQEEFLVGDECCPMCNPGYHVKQVCSEHTGTVCAPCPPQTYTAHANGLSKCLPCGVCDPDMGLLTWQECSSWKDTVCRCIPGYFCENQDGSHCSTCLQHTTCPPGQRVEKRGTHDQDTVCADCLTGTFSLGGTQEECLPWTNCSAFQQEVRRGTNSTDTTCSSQPNKGSGTTSGTTRLLSGHTCFTLTGLLGTLVTMGLLT

SEQ ID NO: 303 - DNA, 1584 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggtgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaa

SEQ ID NO: 304 - protein, 527 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERCGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 305 - DNA, 1497 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaagggagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagggtcctcaccgtcctgcaccaggactggctgaacggtaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggaggacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctccgggtaaattctacacaggagtctatattctgatcggagccggcgccctcatgatgctggtgggcttcctgggctgctgcggggctgtgcaggagtcccagtgc

SEQ ID NO: 306 - protein, 502 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERESKYGPPCPSCPAPEFLGGPSVFLFPPKPKDTLMISRTPEVTCVVVDVSQEDPEVQFNWYVDGVEVHNAKTKPREEQFNSTYRVVRVLTVLHQDWLNGKEYKCKVSNKGLPSSIEKTISKAKGQPREPQVYTLPPSQEEMTKNQVSLTCLVKGFYPSDIAVEWESNGQPEDNYKTTPPVLDSDGSFFLYSRLTVDKSRWQEGNVFSCSVMHEALHNHYTQKSLSLSPGKFYTGVYILIGAGALMMLVGFLGCCGAVQESQCVIM

SEQ ID NO: 307 - DNA, 1542 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaagggagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagggtcctcaccgtcctgcaccaggactggctgaacggtaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggaggacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctccgggtaaattctacacaggagtctatattctgatcggagccggcgccctcatgatgctggtgggcttcctgggctgctgcggggctgtgcaggagtcccagtgcaaaaagaagaaaaagaagaagaagacaaagtgtgtaattatgtaa

SEQ ID NO: 308 - protein, 513 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERESKYGPPCPSCPAPEFLGGPSVFLFPPKPKDTLMISRTPEVTCVVVDVSQEDPEVQFNWYVDGVEVHNAKTKPREEQFNSTYRVVRVLTVLHQDWLNGKEYKCKVSNKGLPSSIEKTISKAKGQPREPQVYTLPPSQEEMTKNQVSLTCLVKGFYPSDIAVEWESNGQPEDNYKTTPPVLDSDGSFFLYSRLTVDKSRWQEGNVFSCSVMHEALHNHYTQKSLSLSPGKFYTGVYILIGAGALMMLVGFLGCCGAVQESQCKKKKKKKKTKCVIM

SEQ ID NO: 309 - DNA, 1515 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggatcgatgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaatcgatttctacacaggagtctatattctgatcggagccggcgccctcatgatgctggtgggcttcctgggctgctgcggggctgtgcaggagtcccagtgcgtaattatgtaa

SEQ ID NO: 310 - protein, 504 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERIDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKIDFYTGVYILIGAGALMMLVGFLGCCGAVQESQCVIM

SEQ ID NO: 311 - DNA, 1548 bp, Artificial Sequence
  Description of Artificial Sequence: Synthetic polynucleotide
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggatcgatgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaatcgatttctacacaggagtctatattctgatcggagccggcgccctcatgatgctggtgggcttcctgggctgctgcggggctgtgcaggagtcccagtgcaaaaagaagaaaaagaagaagaagacaaagtgtgtaattatgtaa

SEQ ID NO: 312 - protein, 515 aa, Artificial Sequence
  Description of Artificial Sequence: Synthetic polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERIDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKIDFYTGVYILIGAGALMMLVGFLGCCGAVQESQCKKKKKKKKTKCVIM

SEQ ID NO: 313 - DNA, 1488 bp, Artificial Sequence
  Description of Artificial Sequence: Synthetic polynucleotide
atgaggatatttgctggcattatattcacagcctgctgtcacttgctacgggcgtttactatcacggctccaaaggacttgtacgtggtggagtatggcagcaacgtcacgatggagtgcagattccctgtagaacgggagctggacctgcttgcgttagtggtgtactgggaaaaggaagatgagcaagtgattcagtttgtggcaggagaggaggaccttaagcctcagcacagcaacttcagggggagagcctcgctgccaaaggaccagcttttgaagggaaatgctgcccttcagatcacagacgtcaagctgcaggacgcaggcgtttactgctgcataatcagctacggtggtgcggactacaagcgaatcacgctgaaagtcaatgccccataccgcaaaatcaaccagagaatttccgtggatccagccacttctgagcatgaactaatatgtcaggccgagggttatccagaagctgaggtaatctggacaaacagtgaccaccaacccgtgagtgggaagagaagtgtcaccacttcccggacagaggggatgcttctcaatgtgaccagcagtctgagggtcaacgccacagcgaatgatgttttctactgtacgttttggagatcacagccagggcaaaaccacacagcggagctgatcatcccagaactgcctgcaacacatcctccacagaacaggactggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaattctacacaggagtctatattctgatcggagccggcgccctcatgatgctggtgggcttcctgggctgctgcggggctgtgcaggagtcccagtgcgtaattatgtaa

SEQ ID NO: 314 - protein, 495 aa, Artificial Sequence
  Description of Artificial Sequence: Synthetic polypeptide
MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKFYTGVYILIGAGALMMLVGFLGCCGAVQESQCVIM

SEQ ID NO: 315 - DNA, 1521 bp, Artificial Sequence
  Description of Artificial Sequence: Synthetic polynucleotide
atgaggatatttgctggcattatattcacagcctgctgtcacttgctacgggcgtttactatcacggctccaaaggacttgtacgtggtggagtatggcagcaacgtcacgatggagtgcagattccctgtagaacgggagctggacctgcttgcgttagtggtgtactgggaaaaggaagatgagcaagtgattcagtttgtggcaggagaggaggaccttaagcctcagcacagcaacttcagggggagagcctcgctgccaaaggaccagcttttgaagggaaatgctgcccttcagatcacagacgtcaagctgcaggacgcaggcgtttactgctgcataatcagctacggtggtgcggactacaagcgaatcacgctgaaagtcaatgccccataccgcaaaatcaaccagagaatttccgtggatccagccacttctgagcatgaactaatatgtcaggccgagggttatccagaagctgaggtaatctggacaaacagtgaccaccaacccgtgagtgggaagagaagtgtcaccacttcccggacagaggggatgcttctcaatgtgaccagcagtctgagggtcaacgccacagcgaatgatgttttctactgtacgttttggagatcacagccagggcaaaaccacacagcggagctgatcatcccagaactgcctgcaacacatcctccacagaacaggactggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaattctacacaggagtctatattctgatcggagccggcgccctcatgatgctggtgggcttcctgggctgctgcggggctgtgcaggagtcccagtgcaaaaagaagaaaaagaagaagaagacaaagtgtgtaattatgtaa

SEQ ID NO: 316 - protein, 506 aa, Artificial Sequence
  Description of Artificial Sequence: Synthetic polypeptide
MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKFYTGVYILIGAGALMMLVGFLGCCGAVQESQCKKKKKKKKTKCVIM

SEQ ID NO: 317 - protein, 288 aa, Mus musculus
MWVRQVPWSFTWAVLQLSWQSGWLLEVPNGPWRSLTFYPAWLTVSEGANATFTCSLSNWSEDLMLNWNRLSPSNQTEKQAAFCNGLSQPVQDARFQIIQLPNRHDFHMNILDTRRNDSGIYLCGAISLHPKAKIEESPGAELVVTERILETSTRYPSPSPKPEGRFQGMVIGIMSALVGIPVLLLLAWALAVFCSTSMSEARGAGSKDDTLKEEPSAAPVPSVAYEELDFQGREKTPELPTACVHTEYATIVFTEGLGASAMGRRGSADGLQGPRPPRHEDGHCSWPL

SEQ ID NO: 318 - DNA, 7796 bp, Homo sapiens
ggggccggggggcggagccttgcgggctggagcgaaagaatgcgggggctgagcgcagaagcggctcgaggctggaagaggatcttgggcgccgccagtctctctctgttgcccaagctggagtgcagtggcacagtcttggctcactgcaacctccacctcctgggtgcaagcgattctcgtgtctcagcctctcaagtagctgggattacagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcgggggggtggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccatagtggccataccaaagaggctaccgattccttcctgctacctggatccctgaagttgccctggtctctgcaccttctaaacctagttcttaagagctttccattacatgagctgtctcaaagccctccaataaattctcagtgtaagcttctgttgcttgtggacagaaaattctgacagacctaccctataagtgttactgtcaggataacatgagaacgcacaacagtaagtggtcactaagtgttagctacggttattttgcccaaggtagcatggctagttgatgccggttgatggggcttaaacccagctccctcatcttccaggcctctgtactccctattccactaaactacctctcaggtttatttttttaaattcttactctgcaagtacataggaccacatttacctgggaaaacaagaataaaggctgctctgcattttttagaaacttttttgaaagggagatgggaatgcctgcacccccaagtccagaccaacacaatggttaattgagatgaataataaaggaaagactgttctgggcttcccagaatagcttggtccttaaattgtggcacaaacaacctcctgtcagagccagcctcctgccaggaagaggggtaggagactagaggccgtgtgtgcagccttgccctgaaggctagggtgacaatttggaggctgtccaaacaccctggcctctagagctggcctgtctatttgaaatgccggctctgatgctaatcggcgaccctcaggcaagttacttaaccttacatgcctcagttttctcatctggaaaatgagaaccctaggtttagggttgttagaaaagttaaatgagttaagacaagtgcctgggacacagtagcctcttgtgtgtgtttatcattatgtcctcagcaggtcgtagaagcagcttctcaggtgtgaggctggcgcgattatctggagtgggttgggttttctaggatggaccccctgctgcattttcctcattcatccaccagggcttaatggggaatcaaggaatccatgtgtaactgtataataactgtagccacactccaatgaccacctactagttgtccctggcactgcttatacatatgtccatcaaatcaatcctatgaagtagatactgtcttcattttatagatcagagacaattggggttcagagagctgatgtgattttcccagggtcacagagagtcccagattcaggcacaactcttgtattccaagacacaaccactacatgtccaaaggctgcccagagccaccgggcacggcaaattgtgacatatccctaaagaggctgagcacctggtcaggatctgatggctgacagtgtgtccagatgcagagctggagtgggggaggggaaggggggctccttgggacagagaaggctttctgtgctttctctgaagggagcagtctgaggaccaagggaacccggcaaacagcacctcaggtactccaggccctcctggctggagagggctgtggcaatggaaaattagtgccaactgcaatgagtcagcctcggttaaatagagagtgaagaatgctggacaggaacctccaccctcatgtcacatttcttcagtgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatctttcaactgaccctgatcaacgaagagggacttgtgtctctcagttggttccaaatgaaaccagggagcaggggcgttaggaagctccaacaggatggtacttaatggggcatttgagtggagaggtaggtgacatagtgctttggagcccagggagggaaaggttctgctgaagttgaattcaagactgttctttcatcacaaacttgagtttcctggacatttgtttgcagaaacaaccgtagggttttgccttaacctcgtgggtttattattacctcatagggactttgcctcctgacagcagtttatgggtgttcattgtggcacttgagttttcttgcatacttgttagagaaaccaagtttgtcatcaacttcttatttaaccccctggctataacttcatggattatgttataattaagccatccagagtaaaatctgtttagattatcttggagtaagggggaaaaaatctgtaattttttctcctcaactagatatatacataaaaaatgattgtattgcttcatttaaaaaatataacgcaaaatctcttttccttctaaaaaaaaaaaaaaaaaa

SEQ ID NO: 319 - protein, 4 aa, Artificial Sequence
  Description of Artificial Sequence: Synthetic peptide
GSSG

SEQ ID NO: 320 - protein, 5 aa, Artificial Sequence
  Description of Artificial Sequence: Synthetic peptide
GGGGS

SEQ ID NO: 321 - DNA, 7796 bp, Homo sapiens; identical to SEQ ID NO: 318

What is claimed is:

1. An engineered extracellular vesicle comprising a plurality of engineered fusion proteins, each engineered fusion protein comprising:
   a signaling domain, selected from the group consisting of either full length or active fragments of 4-1BBL (CD137L), CD27L (CD70), CD30L (CD153), mCD30L, GITRL, CD40L (CD154), mCD40L, LIGHT (CD258), TL1, mTL1, FasL, NKG2 family ligands, and OX40L/CD252; and
   a vesicle-targeting domain linked to the signaling domain, wherein the vesicle-targeting domain is selected from the group consisting of modified myristoylation and palmitoylation tags from MARCKS, transmembrane domain of CD98, and transmembrane domain of CD298,
   wherein the C terminus of the vesicle targeting domain is linked to the N terminal end of the signaling domain,
   wherein at least a portion of the vesicle-targeting domain is embedded in a phospholipid bilayer of the engineered extracellular vesicle,
   wherein the N-terminus of the vesicle-targeting domain is on the interior of the engineered extracellular vesicle, and
   wherein the signaling domain is displayed on the exterior of the engineered extracellular vesicle.

2. The engineered extracellular vesicle of claim 1, wherein the vesicle-targeting domain comprises a fatty acylation site or a prenylation site, whereby the vesicle-targeting domain is embedded in the phospholipid bilayer through covalent lipid attachment to the fatty acylation site or the prenylation site.

3. The engineered extracellular vesicle of claim 1, wherein the modified myristoylation or palmitoylation tag is fused to a transmembrane domain from the vesicle-targeting domain.

4. The engineered extracellular vesicle of claim 1, further comprising a tetraspanin.

5. The engineered extracellular vesicle of claim 4, wherein the tetraspanin is selected from the group consisting of CD9, CD63, CD81, CD82, CD53, CD37, and combinations thereof.

6. The engineered extracellular vesicle of claim 1, wherein the density of the plurality of engineered fusion proteins supports receptor clustering on a target cell.

7. The engineered extracellular vesicle of claim 1, of about 10 nm to about 250 nm in diameter.

8. The engineered extracellular vesicle of claim 1, further comprising one or more secondary engineered fusion proteins, each comprising a secondary signaling domain different from the signaling domain of the engineered fusion protein wherein the secondary signaling domain is each independently selected from the group consisting of either full length or active fragments of CD27L (CD70), CD30L (CD153), mCD30L, GITRL, CD40L (CD154), mCD140L, LIGHT (CD258), TL1, mTL1, FasL, NKG2 family ligands, OX40L, and 4-1BBL/TNFRSF9/CD134.

9. The engineered extracellular vesicle of claim 8, wherein the one or more secondary engineered fusion proteins each comprises one or more secondary vesicle-targeting domains linked to its secondary signaling domain wherein the one or more secondary vesicle-targeting domains comprise a polypeptide each independently selected from the group consisting of modified myristoylation and palmitoylation tags from MARCKS, transmembrane domain of CD98, transmembrane domain of CD298 and combinations thereof.

10. The engineered extracellular vesicle of claim 1, wherein the engineered extracellular vesicle includes an exosome.

11. An engineered extracellular vesicle comprising a plurality of engineered fusion proteins, each engineered fusion protein comprising:
   a signaling domain, selected from the group consisting of either full length or active fragments of 4-1BBL (CD137L), CD27L (CD70), CD30L (CD153), mCD30L, GITRL, CD40L (CD154), mCD40L, LIGHT (CD258), TL1, mTL1, FasL, NKG2 family ligands, and; and
   a vesicle: targeting domain linked to the signaling domain, wherein the vesicle-targeting domain is selected from the group consisting of modified myristoylation and palmitoylation tags from MARCKS, transmembrane domain of CD98, and transmembrane domain of CD298; and
   a linker between the signaling domain and the vesicle: targeting domain,
   wherein the C terminus of the vesicle targeting domain is linked to the N terminal end of the linker,
   wherein the C terminus of the linker is linked to the N terminal end of the signaling domain,
   wherein at least a portion of the vesicle-targeting domain is embedded in a phospholipid bilayer of the engineered extracellular vesicle, and
   wherein the signaling domain is displayed on the exterior of the engineered extracellular vesicle.

12. The engineered extracellular vesicle of claim 11, wherein the linker is selected from the group consisting of Fc domains, Gly-Ser-Ser-Gly, cleavable 2A sequences, P2A, E2A, F2A, T2A, Fc, Fc from IgG1, Fc from IgG2, Fc from IgG3, Fc from IgG4 (4Fc), (GGGGS)n (SEQ ID NO: 320), and sequences with at least 70%, 80%, or 90% homology with any of the foregoing.

13. The engineered extracellular vesicle of claim 11, wherein the linker is an Fc domain.

14. The engineered extracellular vesicle of claim 11, wherein the vesicle-targeting domain comprises a fatty acylation site or a prenylation site, whereby the vesicle-targeting domain is embedded in the phospholipid bilayer through covalent lipid attachment to the fatty acylation site or the prenylation site.

15. The engineered extracellular vesicle of claim 11, further comprising a tetraspanin.

16. The engineered extracellular vesicle of claim 15, wherein the tetraspanin is selected from the group consisting of CD9, CD63, CD81, CD82, CD53, CD37, and combinations thereof.

17. The engineered extracellular vesicle-of claim 11, comprising a plurality of the engineered fusion protein, and wherein the density of the plurality of engineered fusion protein supports receptor clustering on a target cell.

18. The engineered extracellular vesicle of claim 11, further comprising one or more secondary engineered fusion proteins, each comprising a secondary signaling domain different from the signaling domain of the engineered fusion protein wherein the secondary signaling domain is each independently selected from the group consisting of either full length or active fragments of CD27L (CD70), CD30L (CD153), mCD30L, GITRL, CD40L (CD154), mCD140L, LIGHT (CD258), TL1, mTL1, FasL, NKG2 family ligands, OX40L, and 4-1BBL/TNFRSF9/CD134.

19. The engineered extracellular vesicle of claim 17, wherein the one or more secondary engineered fusion proteins each comprises one or more secondary vesicle-targeting domain linked to its secondary signaling domain, wherein the one or more secondary vesicle-targeting domains comprise a polypeptide each independently selected from the group consisting of modified myristoylation and palmitoylation tags from MARCKS transmembrane domain of CD98, and transmembrane domain of CD298.

20. The engineered extracellular vesicle of claim 11, wherein the engineered extracellular vesicle includes an exosome.

* * * * *